United States Patent 12,059,441 (PROBIOTIC BACTERIAL STRAINS THAT PRODUCE SHORT CHAIN FATTY ACIDS AND COMPOSITIONS COMPRISING SAME) - sequence listing, part 14

SEQ ID NO: 29 - DNA, 3656576 bp, Coprococus comes (residues 1,828,289-3,656,576 of 3,656,576)
cactcttctgtgctttttttactccatctacgatttcagaagttgttcctgtaacagacgaaataattacaatagttccttctccaacttttttatttccagttgtcaaatactctgctgcgttttcaacaaaaaatgaaagttttgatttttctttcatatgaacctctgcctggaggcaagatgcatatgttccaccgataccgagccaacaaatattcttgtatccttctttacaaattccatcaatcaattcattaatttgatttctcagagcaagcgctccattcacactttcaatctgtttctgttcattaaatttcaacatagtgttttccctttcccttcttttgtattggttactatttttaaatttaatataccactttttttatttttttcaatatttcacgcaaagaatattgaatattgttgtatttttataaatataaatgcttttttttatacacaatgcatatatttcttttattctggtatgaaacgcatttcaagtttactataccagtttttatatttattttttatttattcatttcttttttcctttctatttgctttttaagaactgacaacgtataatttgattataatttacaagtaaattataatattaggagttcttatgaaaaaaaatttattaactttagatgttgcattatcaaaagaaatcaaatacatgctaaaggaagaacactatcttccaggtgacaaactgccttcggaacgaaagctggcagagctgtttcatgtacaacgcttaactgttcgtggagccttgaatctgttacttcaagataaaacaattatctcaaaaccacgaagtggttattacgtagcgcctaaacgcattttacaatccattcgtaatttttccttacattcagaggaagatagcgaacaattaacttacgaattatatgatttcaaaaaaatagaagcagataactatcttgcaagcgaaatgttacttcctgaaaaatcgaaaatatacaaaattgtttggctttattcagatggtactcaactaatttgtatcaatacaacttatattcctgaatatatctatccagatctcacccaacaaattgctgcttctgctcctgcaattgatttgattacaaacaattgtcaaataaccttggcaaaatcgaatcaaaaagtcaccttactttacgcagacacaaagactgctcaaattttaaatattcctgttggtagccctttaatgaaatacaaagggctcatgtatgataaacaaggacatcttgcagtcttttttgaaaataatatgctaattgatcgttttggttttatcagggaggtagttttatgagcaatgatgatgtattagccgcacaaataaaatctagtatcattacaaaaattaaaacacaggaatatcttcctggggagttgcttcctagcgaacgggattttgcaacaatgtatagtgtaagtcggtatttgattcatgacatctttgacgaattaattagccaacattacttaattcgcgttcacggaaagggaacttttgtccgcaagcccgaacaaaatcgagttgctttaggagtactaaatgaatcaaaaaatgccagctttacctctttagttcgtaactttggtattgaaatttccaataaatgcttaggcacaggtataatcaaaaacagaaaatactttgcagataaacttggactttctgaagaagatgaaatatacggtattcatcgaattcgtcttggaaacaaggaacctcttgcaattgagtttacctatgttcctcttcactttttttcagatatcgataattacaattttgagcacatatcgctttatgattatatgaaatccaaaaatcatttgcctgtaaaatttaatgagacaatgatgatggtagaagctggcgaaaaacttcaaaagcaccttcatcttccaagtgccacctctatcgtcaactatattgaattcataggatacgatgaaaatggtaatttagttgaatatacagaaagttattcacgccctgataaacttgaagtgcgctttgtcacaaatgatatctaaattcactttaattttaccatttagtatgtgtatgcaccataaacaaaacaagatagaatatacacaaaataatacttttgttaggggcggggaaaattgaccacctaaagtcgcttagaattaaccatttttagtcggatagaaaagcttttccttgaaattttcttcacgcttgtcatcgaatacagcagaagcattgtttagggtgtcttaatttatgagaccattatagtactcaatataacaaaaataaggacagctttttagaacctcattagttcaaaaaactgtccttattttccatcctatcgttttttatcttttatgttttcttttctgtatttgtgcggtgtcattccgtaacgtttcttaaatcgcctgaaaaaatagctttgattctcatacccgacaatccagggctatttcttcaatcgaaagctttgtatcgcgattatgtgattgaagaagccattttattctccggtgcaagcccgaggagggacggcgtctgcttcagttcacgaataaaccgatcagtacaatcagcacttttttgtgtttttcaggccagaaccactttcagactgccttcaaaaaacagtttggtataactccaaacgaatacaggcgcaagcggttataaaccgtcctgcgcctgatgatgtcaccatgatcggattcgatgatctgccgattgcagattctttatatgtcacatttcttatacttctcttaagtgctgcttgatccttgcagtaagttttccatccacattatcgatcaggatcgtatctccgctgccaacatttccttccagaatcagtttagctgcctcggtttcaacattcttctgaagatatctcttcaatggtcttgcaccataggtcggatcatatccgccttccactacaagctgtttggctgcttcggtaagctcgatcctcagttctttatctgcaagccgtttattgatatcattgacaagcaggctgatgatagagtagacattatctttcgtcagcggacggaacataatcgtctcatccagacggttcagaaattccggtctgaaatgtgctctcagatcattcatgaccatctcctctgcctctggtttgatatcgccattttcatcgataccatccagcagataagaagatccgatgttcgatgtcatgatcaggatcgtattcttgaaatcaacggtacgtccctgcgagtccgtgatacgtccgtcatccagtacctgcagaagtacgttaaatacatccggatgtgctttttctacttcatcgaaaagcactacggaatacggttttctgcgaacggcttccgtaagctgaccgccctcatcatatccgacatatcccggaggcgctccgatcagacgggacacggaatatttctccatgtactcactcatatcgatacgcaccatattgttctcatcatcaaacagattctcggcaagtgcttttgcaagctctgtcttacctacacctgtaggtccaagaaagaggaaggaaccaatcggcttagtcggatctttgattcctgctttggaacggatgattgcatcggttactttcgtaacgccttcgtcctgtccgatgacacgtttgtgaagttcatctgcaaggtgcagtgtcttgcttctctcgctttcgtttaattttgcaaccggaataccagtccagcgggaaatgatcttagcaatctcatcatcggtaacactttcatgaaccagtgacagatcttcatcttttacctttgcttcctcttcttccagctgtttctgcaactgtggaagacgtccgtactgaagctctgctgccttgttcagatcatagctcctctgagctgcttcgatttcacggttcagctgttcaatctgctcacggatcttctgtacatgttcaacagaatgtttttcgttatcccactgtgctttctgctttgcgaatttttcccgttcttcggcaagttcttcctgcagtttctgcagtctttccttgctcagtcggtcatcctctttcttcaaagcagcttcttcaatctccagctgcatgatcttacggttcagttcatccaactctgtcggcatagaatccagctctgtcttaatggatgcacatgcttcatcaaccaggtcgattgccttatccggaaggaaacggtctgaaatataacggttactcaaagtaaccgccgcaaccagtgcgctgtctgtgatcttgacaccatggaatacttcataacgctctttcaatccacgaaggatagaaatggcatcctcaactgaaggctcatccaccataaccggctggaaacgacgttccagagcggcatccttttcgatatactggcgatactcatccagagttgtcgcaccaatacaatgcagctcaccacgggcaagcattggttttaacatatttccggcgtccattgcaccgtctgactttccggcacctacaatggtatgcagctcatcgataaacaggatgatgtttccatcactgttcttaacttcttccagaactgctttcagacgctcttcaaattcaccacgatacttggcacctgcaaccagtgctcccatatccagtgcaaatacttttttatctttcaaagcttccggtacatcaccacgcacaatacgctgtgccagaccttctactgctgctgtcttacctacaccaggttcaccgatcagaaccgggttgttctttgtcttacgtgacaggatacggatcacattccggatctctgcatcacgtccgatgaccggatccagcttctgctccctggctttttctaccagatcttccccgtatttgttcaaggtatcataagtagcttccggattatcactggttactcgctgattacctcttaccgaagaaagtacctgaaggaaactttcccttgtgattccaagttccttcatcatacctttgatctcacggttcgcatatttcagaagtgcgaggaacagatgctcaaccgatacatattcatcacccatctgctttgcctcatcctcgccatggatcagcacattattcagattctgaccaatatacatctgaccgccctgtaccttcggacgcttccgtaaaagctcttccacacggttcatcatcgtctcttttgtaatgcccatcttctcaatcagcttgagaatcaggctgtcatctattgtaagcaaagaatacagaagatgttcctgttcaatttcctggttgccataatctgccgcaatcttttcaaggttctgtactgctgccatagaactttgtgtaaatttattgatattcataacatgagtccctcctttgccttgctatctttgttctactcgaactatagcacttgttattagcactgtcaatagtcgagtgctaaatctatataaatttttacttccctgtcaaatcatcgaactcattttctgagtcccatctatatgaaacgccccggatcctttatcttcctccggcagcggctttcttatattccatcagtttctgtcttgcttctgcatttaaatgtttcggaacctgaatttgtaccgttacatactgatcaccatggacatttgcatccttcatggaaacgattccttttcctcttaaacgaatcttgcttcctgactgggttccttctttgattttgcacatcacatcaccatacagggtatgcacccttgcttctccaccaaacacagcagttgtataaggaatgctgaccgttgtataaacatccataccttttcgttcatatccggctttcggctgaacagttactttcagaagaagatctcctgccccaccttttccggttcccggcattccttttccacgaagtcttatactctttccactgtcaattcctgccggaatatgcacctcaagtgtctgcgcctttccgctctgatcctgcagagtaattcttttatcacatccaaatgctgcctcatcaaatgtaacagatacactggcattcagatcctgtcctttctgatcaaagcctgctgacccgtggttaccaaatcctccgaagccaccaaatccggatccatcgtcatagaaactgcttctgtgaaacccatgacctccgaaaccatctgtgcttttactgctgcttccatggaatatatctttaaacatatctccgaaaatatcatctgcatttcctgtaaaatgatactcctgatatcctccaggaccacttttgaatccctggaaaccatttccaaatccactgccctgatagctgcctcctgcagactggtcaaatgcagcgtgtccgaactgatcgtacatcttcttcttttccggatcactcagtaccgaataagcttctgttacttctttgaatttcttttctgcatccggatttccggcattggtatccggatgatacttcttcgccagcttccggtaagcttttttgattgtcttctcatctgcattctttgctactccgagcacctcgtagtaatcccgctttgctgccatgttctgtcacctcctgcctgtaaaacaccccggagattgctctccgggggaaatttatcttctatattaaccttcaattgtgatatatttcttctcttctaccgctggttttgcttcttttttcggaacaaaaagtttcagaataccatgtttaaattctgctttgatatcttcttctgtgatatcttcaccaacatagtaacttctctgacatgctcctgcgtaacgttcacggcggatatacctgccggtttctttctcctgttcatcctgatcaagacctttcgctgcactgactgtcagataaccatctttcaattctgcagtaacttcatctttcttgaaccctggaagatcaatctcaagttcatatccatctttcatttccttgatatctgtcttcatcagattattcgcatgatgtccatagagcttcttttctgctctgttctctgctttatctgcatatccgtaaaacggaaatccaaaccaatcatcatcaaataaattattattaaaaatactaggcattaacataagtcctgtctcctttcaaacactcataatacgttcggaacactttctggcgaacctttcttttcgttccccttcctttgttctatctgtactatagcacgcgttattagcactgtcaagaggtgagtgctaattatttgagattttttttgcaaaccttgattttacgaggtttgcaacactttttcttccttataatcaccactttttcttgatttgacaccattttgacaccaatttttttatttttggtgtcaactaattgctacgctttccagccttgtgatttcactctcaattctggacatctcacttacatggttatatacgtccattgttacatctatgtgggcgtgtcccataatatattgaagaacttttatgtctatcctcttttctgccattctggtacaagccgtatgtcgcataatgtgtggatgtgtcaagtataggacaaaaaaaattttatttttttctgcagaagactatctgacgcttccatcaggtagtcccagcacctttattatcttctgataagtcatttttgtcctgctcaagttatctctgttctgaaaaaatatcgtcaaaattccattcgatttcgatttcatcctgactatgaacacggatcaccttgataatctcacgcagcttctctgtatcgaacttctgaattcccaagaaatcttttagttttattttatcagaaagttcattttgttcaagaaactttttgctattctccgcatcttctatttttcgtttaatttcatccagctgtccacttatcttttccgctctctgcttatacaaatcacgatccatacgaccatctttgtaatcatcatagagtttcatcttttccgaggtcaactgtcggctctgcttttgcaattctgcggtattgatctctttgtagtcgcattgcctgttgtaagatactttcttttctttttccaacattgacgctgcatactgatgaacaagcccaaggatattctcctccagcggttcccgtcggatcaccagacttcgacacacaggatctccattggttcgagcatctgagcattttagcagatgctccgtttcttttagtaaagaatgcccacagttggcacatagcagcaatgccggctgttttttacgtctttccagagtaaaattggtgcgtgattccgcaacacttctcttctttttcggatgcatttcatttgctttttcaaacaattgcctgtctataattgccgtatgatgattttccaggcgaacccattctgtttcatcattcagaacagctttatggccagtatgcatactacaacgcgttttgccccagattctggttccaatataaatctcatcccggacaattgccgctactgtcgtagggctccagtgtttctttttgatcgtctcaaacctctggaactgtacctggtcccctcttgataatttctgctcatcacaagtgacaatctcctgtctgttcaattcccttgtaatatctgcaaaacttgttccttccgctgccatccgaaaaatcatttttacgacttttgcagcctctggatcaacttccagccttccatcttttccttttttatagccatatctggcatttaccggaaggcgtgtaccatttctcgttcttgtctgcaatgctgatgaaattttcttggacaaatccaggctatacatattgtataccagattctgcaatgccacattcattccaccagtcattccgctgcttgcagcactgtcatagctgtcattaatcgaaataaatcgaatctgtagaagtgggaaaatatattcaatataaaatccaacttccagatagtctcttccaaatctggagaagtcttttacaactacacagccgatttctccgcttttcatgtcatcctgcagctgttgaaatccctgccgtttaaaatgagtaccgctgacaccgtcatccacatattccaggatatctgactcagctacacccagctgatcaatcacaaatgattttaacagaattctctgagaagttacactgtcgctctcttttttggctctgccatctacattgtcatcttctgcggataaacggatgtaaacagctgtttttctatgatctgtcatcttgtctgcgcctccttctctttctttaatttctgtaaatctgcaaactgatcgtcatataccagcttgatctcataatcatacttaccatggataataattgaatccacaaaggcatctgccatttcttttgtcagcttacgctttgacatataagtatgtatcacatttccccagccttcttcaatgtggtaatcctgggaataccgaacctgtgccgccaatactgtgtccagacggctcttgatattctcaatttcattggaatagatccgagaaaactgtatgtactcttcttctgtaatcaaacgttccgagtaatcttcatataaatccgatttacgcttactgatacggctcagttcccgtcgaagtttccccacttctttatccaaaagcaggtactgtgtctgatttttggaagctgtattcatttcctgaatcattttttccgtatccaatacggttttcatatgcgtttggatcaggcgaagaacatcgtcatccacatattcttttctgactctgtgccctttgcattgctttcctccggatttatggttagtattggctccgcagatataaaagaatgtgccatttctttctctggacaacgtcatgcggttgccacagcctccgcaccatatttttcctgtatagaaattatgatttcgaatagccccattgttctgctgatgtttcttcttataagcttccgtatattcctgaattttagattgtacctgttgaaacaactctctatctataatcccttcatgcgtgttctccacatgcacccattcactctctggtcgatttctctgtttattttcctggaaaacactttgctgatattttccaaatacagaatcacctgtgcaatgaacatcctgaagtactcgcttcacttcataattattccagggtttagactccggaagcggcttttcaccggttttatagaattttctctgtaaagtcggcgataaaactccatctttattgagctgtcttgcaatatcactataattcctgccatccatatacatagaaaatatacttttcagatgttctgcagcttcatcatcaacaatcagctgatgatggtcttcttctgactttctgtaaccatacggttcccaggcacttgtaaattttccctctttccaaagtgctttttttgcgctgctactcttcttggcaaggtctttcgaatagaattcattgatgatattcttcagtggaactgtaagatccacaccttctctgaaagaatcgaaatcatctgtcacagccaggaatcttacatggaaaaacgggaatactcgttcaatataattgctggtttcgacataatttctgccaagtctggacaaatcttttacaataacacaattgatttttccatgcttgatatcttccatcatctgtacgaatccaggacggtcaaaatttgtacctgaatagtctgagtccttataaactttcgcaaccgaaatatcttccgtatctgctacaaagtttttcatcaattccacctgggtttctatcgttcctctttctagtgtttcttctgtttccattgaaattctggcatacaatcctgcccggaatggtctgctcatctctgtctggacggttgcactgctgactacttccggaatgtttttcctgctctttcgtgccattttatacaacctcctttaccttgacctgcagattattatcatcatctattaccgtatcaactcccatagccggtaattgactcagcaatgtctgataacaatcatcaaaatcaaaagtgatctctatattctttttatcatatactcggatttgcctgatcagttctaccaccacagtgcgggacagttcttcaatatcttgatatttcacaaaataatccagccaggtattggcattgtctgctttttccagctcactatccatttctttctggatcgcacggatactctcttccgcatttttaagcctctttccataggctgcatgaagctctacatagtcttcttttgatacaatgccctctttcatatccgaatagagcatcatccgtaactccttacagcgttctgtctcctgttttttcttctccagcctgtcctgcagcttcttcatattgatctcctgaaatggcacagtaccaacaaattccaggactcttttcaggtgcaggatattctggatatgctgtttcagcatcaccagtacggcatcttccagatccttttccggtattctatgactggaacagcgttttgtttctttatttgtggaacacagataataagcatattttttccctgccacagtagaaacctttcttgtcataggtgctccacaatccgcgcatacagcaattccggataacagatatacctgcttttggtcaggtgaagtacgtgtatccatgccaagaagcctctgaacaatttcaaaatcacggtcactcaccagaggttcatgatttttctcaatccggatccagtcatcttccggtttcacataagtctgcttcactttatggtttggtgttgtcctttttccctgtacaaggtttccgatataaacctcgttttccagtattctgcggactgtaacagaactccaaagtgcctgttctttctgtcgaaagccagtttcataatgactgccactgctgattttatactcaaatggggaaagaatacccagttcatttaaacgattagcgatcgcatcctgactcattccctgcagcttcatcttaaaaatatcctgtactacactgcctgcagatggatcaatctctaatttatgcttatctgtctttgtcttcctgtatccaaaagctacaaacggagtcacgcattcgccttttttcctcttaatctcaagattactcctgatcttaatagaaatgtcacggcaataagcatcattgattaaattcttaaatgggataatgatttcgtctgcctgattctttcccttgagactgtcataattgtcattgatggcaatgaagcgcacaccaagagccgggaataatctctcgatatacttcccggaatcaatatattcccttccaaatcgtgataagtcttttaccactacgcagtctacaatcccacgccggatatcttccagcattgcctggaatgctgggcgctcaaaattagagcctgagtatccatcatcaactcggactgaaacaacttcaatatcttttttgtctttcaggaaatccagaatcaaagctttctggttagaaatgctgttactttccagttttgctgaactggaaatatcgccatcttctttagataatctgacatagatggcggcatgatagattttattgatattctgatacatatcttacctccttttattacgtcagaaaatccatgtaataaaagggggctgcataatttgtccttaccgacattctaacacagtcccctcaatcttgccagtactttttcagacactcagaagcatattctcaaatgcctgctccatagatataccgttattagcaaatctgacttttactttcatattaccgatccggaccaaatatggatttcctactttattcagaaaaatatctctccgttcctgaagcgatttatttctgtctgcttttatcatccgtaggtcagtcatttcattgatatctacatcactgaaatcctgctccagatagtttctatattcctctgccgtcatgcccttctccctccattcccatctgaatccgtactgctttcagtacccgatccaggctccacttgttcactcttccgcatttctcaataatacatttcgtagaaatgctcataacctgttcagccagtgccaggcttccttttcggattcctgtcatatcatatttgctgataaatacatgtgttggcaaataccgtttcttatatattcttgatgtcagcggaactaccgttatgactgaactgtatgtattggctttattattgctcactacgatcaccggtcttacaccaccctgaacagatgttgtaggaaacataccgagatctgcccataaaatatctcctctgcggattgtcatttgtcctctctccaatctattatttttatttgtaaagcatccatagcgctatattggctccacaggaatacggcagagtttctttcccataaggaaagctctgccgcataacctctatagccaatttgattattaaacagtgctcgctcgattctatttatcctcgataccccgaatcgttactcccgcatatgcaggaagggaataataacctgcccggatgcatactccggaccacaacccggaaactctcgtttccaggctccagcagttcataggtttaccagttacagacttctcaggatctgcaagtgtatcgcatctcatacatatcatcgcatcaccagcctgccagctggcttcggtcagtgctttttcgcagcattacggactgaactaaaaatcttggttttgtcttataatcctatagcgtcatcttcctcgtgctctctgcatgaaatgtcacgtcagttattattggatattcagttatcatggttcattttaggaagtcatttaacttcctctaattactaaagtcaaatgactttggcagatgcaaaagattttgaaaaattttttaaaaaaatttattcatatacatttcacgcattttattaagaatggatttcagcttgtatgacagcatctgtctggaaatccccataatttccgccatctgtgtctgtgtcttgttttcaaagaaaatgccataaataatcatgcgttcctctgagttcagctgattgattactttgtgaatatcctgctgttccatttttgtcagtacacagtgctccacatcacagttcagatctggaaaatcctcaatcatgaaaccttctccatcaatagactgaccgctgtaaggtacttctctcagcatcttatccacgacttcccccagctcgttcttaatctcaactttttttgccttgctgcttctgtaaaaattgttcatcgcatacgcaacttcttttgtaatctcgatcatttctccatcaatatttgcgtaatactttccttcgtaaaaatatgggtgttcaatatacatatccgtttctcctgaatttgaaatcttgttgctcgtttcaaatccagaaggcggacctctgtttaggatcatgcctgctccgcctttatcctgccgggatatgcccgcagttattggctgagaaattcaggcacgaaaaaaagccccagtagttttttcttaactactgaggctttcgtctctttcttgtattcagttatctatgccttctttcatcagcataatcattgtatcaggataaagttcacaaagtatccgcaatatattcccataagttcatgtcattattgaaatcgtacatatttcagtataaaaagttcactgtattattcttctacttcttttccatctatatatagttgaaatttatcaggatgattgacaacatcatagtcctttccatattctacagttctgtattcggctgtcattaccgattccccatcttcaatatcctctttccataaatagatgttcatatcaagactcgtcgcatatcccctgtctgtggagaattttgtcgaatgaaaagaatcatccttgtacatctgcaaaagctctcttgcaaacgcttctctatcctcaatattttcccggttagcgattacggttagattttcatcccgatttacggaaaatgttcctaccacatccggttcaccttccttatgacttgattcgggtttcccataaatacttcctgcagcaattatcaagatgactgcccctgagatcactgcaattatctttttcttcatatttttattttccttttagttttttttactgcgtaattgattacttcttccggtgtaggtctttctcctttaagtgtcattttcttccattcttcctgcacggccggatcaggattatcaaatcctgtatctatggctatctgcatttctctgcgtacttcttctggtgtcgtattgtacttttctgcaatcttctcataaatatttttttctctcatttacccgccctccagtttcaaagaattatttatagttctttagaactactatatcatgattatcactatgaaaaaagattttttcacaaacgaatccataaaaaagaataaaaaaaagaagagcttaatgcccttcgatttcaatgcctatttcattagtctaccaaagctctgaccgcatttaaaattcttttctgctcgtcctttggcaatttttctatcatatcagataattcattagtaacacctgtgacagaatgtgtcacaacatctatcagtagcgcatcagccgatacatcaagtgcattggcaattgctacaaaggtatccaactttgttactttcagtcctctttctatcacactgacatgtgttgtacttaaatttaccagcgccgccagttcttcctgtgtaagattttttgcttctcttgctgctttaattcgctgaccaaccgcttttaaatccatcatagcacctccttcagaacgataattcggtctaaaattagtatactgatggataattgaaagatacagaatccgcaaatcaagttgtagttctatagaactaattttcattttttatacatgcaacacacaaaaaagccaccagaagaattagtatcctctggtagctccattaaaatttatcatttgttaatgtgcaacactcatgctctcatcaatccatttctgcaccatttgaacactcacattaagatagtgggctattttatcaactttcattccatccgcagccatggataatgctgaggcttttgcttttttcagctcaccactttcaataccttcactataaatctgttccatctcacggcacatgaattccacccctttctgtgtttccttcaattcgtatactctgtcagcaagtatcttactgtgcatatcttctgcattcttacagtgaagatcatgcatcagtctgcctaattctgtatcctcttgtttcttagaatttacatagataatatgagcttcatccttaaaattctcactgacttcttcgattttcctgtctatatgataaatcggaagtccgtatccaagtgcatcgtctctggtgataaaaatcacgtagctttccggaaggtcatcaaaatcctgtcctggatttaatgtgttcatatccatcagaccactatgataccttgctcttttgggagatgccccttcgttgtcctgttggatttctacatccatctgcttgccttcagaatctctggcaacacagtccagaatagctgaacgcccctgcaaattcttatagtctttctgcagaacttgatcaatcactttcagatcctttttattcataattacctgcagaacatattctgtacattcccgtttcttgaatacattccgcataaacacatcgctcatgatggtaaggtcttttaagatacccttgtatctttcgtaacgtgtttccaattcttctgttttcacgatttcttctttcgccacgtccattctcgcctccattctttgctatgtcaggataggttcctaaatgtctcctatcccaatttcatcttaacatcaaaatcagcttttcacaagccactattttatcctacaccacttgaaaacaataatttccaatcagtttcatccaactattatatttattcttttcacacacctttcggcaaatttcattttccatcaatacacagaacatcttatcataatcaaatgcccaaacagcaccattcacatggttttccactgctttctgatctatgcttttcaagcgtgtgaccattttctcaatttctccatttcccaagttaccgatatttttgcagataaaccgaaagaaattcaacgttgcatattcgtcatgccaatggaactcttctggattgtttttaattttactgactcgctgctgttctttgattatctgagcagctacacctttcatcgaatcttcgtatctcatattattcacctactcttcctcaacgcccagtgacggtttaaatcttttatcctttgcctgcggtaccacgatctcataaaaataaaatcctaaatacccaagtgcctgcttcttcattttataaaaagaagtcctgcctattcccaactcctgttgtacttccacatctgtcttattataatgactgcaaaaacaggaatgaaggatttcactgagcatcacaccattcggtgcatagaacttcaccaaagtcattccccgatagatcatgtccgacaatccataaataatcatcagattattcatctcccggtgcatctttggcacattcagctggttgttataaatgctcagataactcaatacatatgccatatcttcattgattttctcctggcattccatatccagttcttctaacacaatctgattttccaaaatcaatttctgatagcttgtcatcaattctttaatgtcagtataatgtctttcgattgtaacttccagataatcctgtgcatgacttgccatctggaaggtaatttctttcattgatttaattgcataatctctgtctgtcatcagtttcaaaatctccttatcatcatcacactaactggcggtctttcagaccagttcgctttccccatgattttgatgggaagcaattacttactacaacttgcagaagcggatatccaaaaggcattgtgggagctgcctttgctgaccggaatccatcttcttatgtaaaacctgcaggaatataaagggaaagtgactatccctgccggttaataatccaaataatatcgtctataccaatctctccttatgctgtttttctctccataaaccatttatccacttcgtaaaacaagtggctttcctgcccctgtatcatacaggtgtacatcattcctacaccgcctgcctttctgctggcgcatcgctcgattttcaaaattctgtcaatgctatactttcttccatcctcccatgtaaaaaatataggaaccagctgtccgtctttccgaaactctgctactacatctacatatactttgttcatgccgacacctcactataaaatctcaattgctcttggcgatgccgggattctgcggatatatccatttaactccaactgcttgattctggaaaatgctgatgatgttgatttcaccccgatcaattttccaaattcccgtactgtcggcggatatccatgctccttcgtataatccaaaatacactgataactttctttctgttttctggttaatgcttttttcaaatctatccctccaattacccatgaaaataactgtgtggatggatcgtgtgcgtaccagcgtctaagtgggataagactttatcctgatacattgccgctcgctgtatactgaaataaccaaaccgtcgtctgatctcatctacagtacgatccagcttctctaacttttcctttttctcctgatttccaaataaatccaactgcacgggaatattatctaacacaagatccgcagctcgaattcccaggcttctaatgggatgttcccatttataattatctttaaatagctgaaatgctgcagttacaatctcgtttgtaatattcgttggctgtcgtaaatgtatctgtctggaaaaactatacaatccattatctcggactgtaatttctactgttttgcatttaaatccatgtttccgcaatcgtgcagctacactttctgccaatgctatttgaatgatccagacatccagatcattttccagatctctcggtgttgtagtgctattacctatcgactttactggtgcttcatatccttccttgcaaaccggatcttcatcccagccatttgcgaaagcccataatacatttcctatttttccaaaatgactctctaacaacttttcgtctgattccgcaagttgcccgattgtccggattccaagtttttgcaatttcttatttgtctgtcttccgacataaagcaaatctgacgctggaagctgccatatcctgtctttataattttctcgattaaactctgtgattgcatccggctttttataatccgaaccaagtttcgcataaatcttattccaggaaattccaatactcacagttactccaagttcgtatttaattcgatggctgatttctctcgcaatcgtcattccgcttcctttcagatttccactgtctgatacatccagccaggcttcatcaattccatatggctcaattttgtctgtatactctgaatagatttctcttgccatttgtgaaaatcgcaaatacaaatccatccttggtggtacaaaaataatttccgggcaaacctgtttcgcctgccataatgccattccggtctttacacctttttgctttgcaatataatttgctgtcaatacaattccatgtctggcttccggattgccaccgactgccagaggcattccggcaaattccggatgatgcagcatttctacactggcataaaaacagttcatatcactatgcaggatcacacgctcactcaaacttttcacctcccagctgtttccttcaacatgatgtcttatcaatttctgtatgtttagtatatatcgacattccggagatagtcaagtgacatcttggttgtattttctccattttggagattattgttgattttatttttaacatacggtataatgcatatagaaaattcaaatagaaatgaggcgaacaaatgcgtgatttcggggaaatattagcagaaaatagaaaaaagaaaggatactctcaatcagatctggtggacctgctttctcaggaaggtattcaggtcactacaaaagcaatctccaaatgggagaccaatgcacgagaaccagctttacatgttttcctgacactttgccagttacttgatatcgaagatatatatgaatccttctttggagaaaatccatataacattatgagtggattgaatgaagaaggcagaaataaattgattgaatttgctgatattttaaaagcttctaaaaagttttctccactatctgcaaagattatcccattccatcatcctgtagaaattacctgggaaccagtttctgctggtactggaaattacctggaagattctgtaaaagaaacctatgacgtaggacatcttgctcctgagcagactgactttggtgtacggatctccggtgatagtatggagccactttatcatacagatgatgttgcatggattcagaaaaaagattctcttgctaatggtgaaattggaatcttctatctcaacggcaatacttacatcaaggaattacacgatgagccagatggtgtttatctgatctctttaaatcaaaaatatcgtcctatccaggttttggaatctgactcttttaaaatttttggaaaagtaatcgggaaatgcaaaggtgcagaaattccgggatttcattagatttcaacagcaggttcatgatcctgctgataacaataagcaaaggaagtgattgaatggcaatcaataatacattaaaagatattcgtgaagaacggaatctcattcaagcagatttggctgaagccataggttcctgcagccagactataggccgcatcgaacgtggagaacgtaatccctctcttgagattgcaatccggctggcccattacctgaaagtgcctgtagaagatatttttcaagttgaagactgaagcataacagccgaaaaaccgaggagtaaaatccccggtttcccttttgctcaaaaatcactgtaaaccacttacattttcttcttttctgcctgctccatcaatcaggtcataactcatatccaaaaagtccagtatctttgcttcactgaccgaaccatccagtaaaatcgtaatccagtgccgcttgttcatatggtatccaggtaaaaatccataagtctgaataatcatgctggtcatttctggatcgcactttacatccatgatgtcaaccagatcatttccctctaatcccagtttcgatttttcaaccgtcatgatcactgcataccatttcccattcttatgtcgaagtactgcactgtccggtagtttactccataaatattccggaatcgtgccatactgtttctgcacatattcaaaaatttcttctttcttcacaatctattcaactcctgattcttctgatatcctgcccctaatcataccacatttttgtatgccatactacctgccaaattcttttgcatttctcttattcttctgactttagctaatagaggggtaaaacagcaaggacaggaagtgaggatacacttcctggaaatcccaatttagggaaccctgccctaaattgaaaaaagctgaaagcaacgatactactaccttctcagaaaggagaacacgccaatggctgaaagaaagagaagcaaagaaatccatttctatgtcacagaagaagaacggaagcttatccgcagaaagatgattgaatcaaagaccaaaaacatgggagcttatcttcgtaaaatggcaatcgacggttacatcgtcaacaccgatactactccactgaagaaacagtatgaggaaatgcataagattggtgtgaatattaatcagattgcgaaaaaagtaaacagcaccggagatctatatccggaagaaatgcaagaattgaaagagatggtgaaagaattatggcgtatcttaagatcttccccattaaagtaacagacaagaaagctctggactatattacgaatcctgataagactgatgaaaaactgttagtttccagttttggctgttccccggaaactgcagatcttgaattttctatgacaagagaaatggcaaaaaagaatggaatggacaaaggtgataacctggcatttcatctgatccagtcatttaaacctggagaagttgatgccgaaactgcccatcgcttagggcaacaatttgcagacgaagtactgaaaggaaaatatgaatacgtgattagtacccatgttgacaaaaaccacattcataaccacatcatctttaatgcagcaagttttgttgatcatcacaaatatatttccaataagcggagctaccataaaatctgccggatcagtaatcgtatctgccatgaaaatggacttgccaccagtatgccaaccggagaaaaaggtaaaagctataaagagaacatggaataccatcgtggcaccagttggaaagccaagctacgtgttgcagttgataaagcaatctggacttccatcaactatgaggaatttctacaaaaaatgcagttagccggatacgaaatccgccaaggaaagcacctatccttccgtgcgcctgaacagaaaaacttcacttatatgaaatctctcggaagctattattcagaagaaaatgttcgcattcgcctggctaaaaatcgtaacaaagtgaaaactccgaagcatctgtccagagaagctcgcctgtatatcaatatttccacttatgttacgaccggcaatcgagaaggatttgaacgatgggcaaagctcaataatctgaaagaggcagcccgcacctttaactatctttccgaaaataacctgttgaattatgaggatttcaagcagcatgtatctgacattgaagtttctgtgaaagttgccgaccaaaaaatagcacaaatcaacagtgagctgagcacacagaaagtcattcaaaagcactgtgattcttatcggctctgccgaaaagtgattgaagattgcaaatctgctaaaaatccaaaagcttaccgtaccaagcatcaggcagaataccagctacacgattcactaaaaaaagagcttcaggatctcggcgttaccaaaatcccaagctctaataaaatccagaagcagattgaaaatcttgaatctgaacaggctgctaccgtccgagaaaaacaggagctgcagaaaaagcaaaagacacttgatatcattcggcagaatttcacatcactgcttaatgctccagagatgcaagttcccgtatcaggaaaagagctagctctttaaaaagaagaggtacctacttaacggtgcctcttcctttccatctaatctattcttgcgctaccctatcacactcgcacccaaaagtagtccacgcatacttatttcaatcaaaaaagaaaaagagcatatgaatttgattgattccatacactctatatttataatcttcatacttattttgccatttcaaaaaaaccgataattcctattcatacatctttcttcataggcgaccacagcgtatgtaatttcagtttgtacatctgactgtcattttccactgttgcttttatctgcacagaaatttctttatttttcacagatgaatgaaaccagataaggagaaaacgtaaattgtgttaatgatagcagacatgattatggagtgaatatcttatttggaggaaaaacaaatggtacaatcaatctttgaggaaatgggcggcagatacgaacggcaaggcgaatacattttaccctgccttaccataccacccgaaaaggaacagccgatagacttattcggacggcggcacttggactatctgcgggagtaccgcaaaattacatacaccaatcttctcacaagcggcaggctcaatgcttaccttgccgacattgacagacaggcacaggaacgctttgaacggctcatagagggcatgaaacaagcacagggcataacagaacagttaaaggcagaaaacgccttaaaatggactggaagaatgaataacataagggcttgtgcgagggagattgtggaaaaggaaattatttttgcataaacagatgattagtggcagggtgaaatcctgccactttttctgctttagtttgtcagcttgacaaataaagggttaaggaatataattagattcagttttatacaaggagttaataaatatgcggcaaggtattcttaaataaactgtcaatttgatagtgggaacaaaaagtagcagtcccgtttcacttttaatatggggcttggttttttgtacccagtttaagaatacttttatcatgtaattttatatgcccgaaaacatataagtgttttggggctatgggagttatttacccagtgataggagtatttatcactgggtatttttatgcccttttttgggtgttgataggaggaaaatcacatgaaaataattaacttaggcattctggctcacgttgacgcaggaaagacaaccttaacggagagtttattgtataccagtggtgcaattgcagaactagggagcgtagataaaggcacaacaaggacagatacaatgaatttggagcgtcaaaggggaatcactatccagacagcagtggcatcttttcagtgggaggatgtaaaagtcaacattatagatacgccaggccatatggattttttggcggaagtataccgttctttatccgtattagacggagcagtattattagtttctgcaaaggatggcatacaggcacagacccgcatactgtttcatgcactacagacaatgaagattccgacaatttttttcatcaataaaattgaccaagaggggattgatttgccaatggtatatcgggaaatgaaagcaaagctttcttcggaaattatagtgaagcaaaaggttgggcagcatccccatataaatgtaacggacaatgacgatatgggacagtgggatgcggtaattatgggaaacgatggactattagagaaatatatgtcagggaaaccgtttaaaatgtcagaactggaacaggaagaaaacaggagattccaaaacggaacgttatttcccgtttatcacggaagcgctaaaaacaatcttgggattcggcagcttatagaagtgattgccagtaagttttattcatcaacgcctgaaggtcaatctgaactatgcgggcaggtttttaagattgaatattcggagaaaaggcggcgttttgtttatgtgcgtatatatagcggaacattgcatttgagggatgttattagaatatctgaaaaagagaaaataaaaatcacagagatgtgtgttccgacaaacggggaattatgttcatccgatacagcctgctctggtgatattgtaattttaccaaatgatgttttgcagctaaacagtattttggggaacgaaatgctgttgccgcagagagcatttattgaaaatcctctccctatgctccaaacaacgattgcagtaaagaaatctgaacagcgggaaatattgcttggggcacttacagaaatttcagatggcgaccctcttttaaaatattatgtggatactacaacgcatgagattatactttcttttttggggaaagtgcagatggaagtcatttgtgccatccttgaggaaaaatatcatgtggaggcagaaataaaagagcctactgttatatatatggaaagaccgcttagaaaagcagaatataccatccacatagaagtcccgccaaaccctttctgggcttctgtcgggttgtccatagagccgctccctattggaagcggagtgcagtatgaaagcagagtttcacttggatatttaaaccaatcgttccaaaatgcggttatggagggggtcctctatggctgcgggcaggggctgtatggatggaaagtgacagactgtaaaatctgttttgaatatggattgtattatagtcctgtaagtacccccgcagactttcggctgctttcccctatcgtattggagcaggctttaaaaaaagcagggacagaactattagagccatatctccaatttgaaatttatgcaccgcaggaatatctctcacgggcgtatcatgatgccccaaggtattgtgcagatattgtaagtacccagataaagaatgacgaggtcattctgaaaggagaaatccctgccagatgtattcaagaatacaggaacgatttaacttatttcacaaatgggcagggagtctgcttgacagagttaaaaggataccagccagctactggtaaacttatttgccaaccccgccgcccgaatagccgtatagataaggttcggcatatgttccacaagttagcctaacagcttgcgaaagtcgtataaaatgagatttgaaaggattagaagctaattatgatgaaatgcgaatagatattgtgccctgtttgtgggagcaaaacccgtaataaaattaggaaagacactgttttgaagaagttttgaagaattatcccctttattgtccaaaatgcagacaagaaagattgattaaagttgacaacttgaagataactgtcatcaaagagccagacgcttaagacgcagagtcgatgaaattgtggaacaattcacgaatcatcggctctttttgtttcgtatttgaaagaacaaactcaccaaataaaaaaacgatattcgggtcaatgtcattaagttaaggaaaaataattagattcttatattagaaataatataggagtctttttattttgtaaaaatagttgacaaacaagatagaatgtgcggccgctttcgctaccgatatatattaaggttgcgaaagcggcccttgtaattaaggaatatcttgattgcaaggaggatacattatgagtcactatattgaaaaggttacggtttcactagaaaatctaatttcagaattggcaagaaatccatctttgttcttgaaaaatccagatactgatttttcaagaaaccgcaaaattaattttaagacatgtgttggcattaccatgaattccggcggttgcacgctgaataaagaactcttggattttttcgattttgatgtgaatgctcctactgtttcagcgtatacacagcagcgggctaaaattctaccagaagcatttgaatacttatttcatgcgtttacagaagaaaatgctcaaacaaaaaacttatatgagggatatcaacttttggcttgcgatggcagcaatctaactattgcaccgaatctaaacgacccggaaactctttggaaatcaaatcaacttggtgcaaccggtaatcacttacatctaaatgccctgtatgatgttttaaacagaacttatattgatgcattggttcaaactgcctctacgtatcaagaacacagagcatgcattcaaatgatagaaagggtgacattggacaaagttatattaattgctgatagaggatatgaaaactataacattatgtctcacgcaatagaaaaaggctggaaatttttgattagaataaaagatgttcacagcaatggcattgcatcaggcttagaacttccacaaacggcagtttttgatatggatatcaatctgattctgacacgaaatcaaactaagtcaaagaaacaagcaggatataaattcatgccaacagtacaaacctttgattatcttccaataggaagcaaagaggattatcctatctcctttagaattgcaaggtttaaaatagcagatgattcctatgaaacggtaattacaaacttggaccgtttttgcttttcggcagaaaaacttaaggaattatatcacttaagatggggcatagaaacatcatttcgtgaattgaaatatgctatagggctaactagttttcatgccaaaaaagtggattacataaagcaagaaatatttgcaagattgaccttatataattactgcgaattaattacaacatatgtagttgaacacacagaaaatataagtaagaaaaatcaggtgaactttactattgccatttacatttgcagagaatatctgcgacgcaaacggaaacttcgtccacctgatgtggttaaactgatagaaaaacatatattaccaataagacctgggcgtcgagaccctcggaaagtcaaacatcaggcgtcagtaagttttctatacagggtagcataaccattcatcattatataggattatagacagatgtacaatccatctgtctgtttgccgtgcaaaaaaacagataacaaaatgaaaaaagcaaaatacaagtgagattttacctacttgcattctgctttttttaatttttaaattaacttaatgacattgatattcgggtgggttattttgttataccctaaattaccctctgaatttgtttttaaatttggagggtttttatgttccttttttcgggcggttgtccatctgcttatataaagcaaagtttatctatacatagcatatcagggactggcaggaagccagttaaaaaaatccctgccagtgcaacggtacttctcaccatgaaggtagaagtacaatctccatacaacagaattagtatttcccataaccgtagaggtcacagagcctttgcggtttttcttttgtcgttttttatcggaatacgccgcagggctgttacttgttttgggtgtcgttccccgcctctccatctggatttttacatttcatcgcaggctaaagcctgctcaattcagattgattggaggaaaaaagaatggcatataacaacggacgtgaggacaggaagtggcgtatctggaaagaagccgaggaaaaagtgttgcgggaacatggagttgatgaaactaccattgaacaaatccgtatagacgacagggcagactttaattccaacaggcggttttaccattggacaagcgatttcggggaataccttgagggaatggcagacaaagagcaatcatccgagataaagaccgttacggatttattagatgaaatcgaggatgaaaatctgtatcaggcattgcttacggtggacaggcgtactctgcaaatcgttctgctgaaaatgcagggctattccacaaaagagattgccccgcttgtgcatttaacgacgggtgctatctatgcacggttagaccatctcagaaaaaagttgcagaagattttataggcatctaatacagcacgctttcttatgggctattgggtgggggataaaattctcccgcccaattttagaataagtgaataaaatccctgtccatagggaatactaaaaagtttgtgcaaaatcttgacagccatattgccgctatggtattctaaaatactaatggggaaattggaagattgaaaattaaataagtacatagatataaaattgaaatgttggtcaatcgacaaggctgacatgggttttgaatttcaaagccgctacataacattgcgaatcagattgagagggaatcctcttgtcgttcgtggtgtggtgcagcggctttttcatttatccaaaagtcaaaggtaatcaaatccagaacggaggtggaagcacataggattttcttttcggagggtaagggcaggtataaagaatgtcgctgcacagaaaagttgccctgcggagatgtccgcagggatagcgagcatcggattgtgtcagccacaatcccaatccacagcctaaaggcgtgtggactaacttaggggacaggtctacgctccgcttcggtcggcgctaagcggacgtccactggacgtccagcgcccctagctaccccgataaaagaaaaaataagactggaggattaagaaaaatgagtagagaaaaatcagaaaaagtatgcattacttttagattgagcgaagaagaacatgaaaaattaaagcagtattcatccgcctgcggtctgtccgcagcagaatttatgcgtcagttatgcaggggaaatgccccacagccaatgccgcaaaccgagttttgggaactgctaggcaagctctatgaagtgcatgatgctttcagaaaatgcgtccctttctatcctgccgccgctgaaatctgtaaggagattgagcagttagtgatggatttgcagcagagatttactatgccacaaccgtttgatatggaaaaatatgcagggaaaggggtagtctgatatggcggcaacgagcctctggcacatcgaaggacggttgaaagacctgatttcttatgtggaaaatccagaaaagaccgtgccgaataaggagatgcaggacttctttgacgtgttctcctatgtgaaaaatccagagaaaacggacaatggagagtttgtttccgccatcaactgtttaaaagaaacagcgttacagcagatgattctgacgaaaaagcagtaccagaagacaggcgggtatatcgcttggcacggctaccagagcttcaagccagacgaggtaacgcccgaacaatgccacgaaatcggcttgaaactggcaagggagatgtggggcgacaagtaccagataatcgttgccacccaccttgacagggggcatctccacaaccacttctgcttcaactccgtttcctatctggatgggagcaaatataattactcaaaatcggagcagaaacggctaagggaaacgtcagaccgcttgtgcagagagtacggattatcggtgattgagaacccgaagaaagccccttcaagaccgctgtatctggatgaaaagagcggcaagccgacacgctacaacgtctatctggaagatttggcggaggcaatcagcggcagtcgggatattccgcacatgatgagataccttaccgacaaaggctacgaggttgatttttcgggcgggcattggaagatgaagctgccgcagtataagcattttacaagattagatacgcttgatgaacgcttaacgcccgattttatccgctcacatttaggcacaagggcaaggtacgggaactataaagcgaggatttcctactctccccatatgccagaggaatataaaaaggcttggaaaccgcaccagaaaaccacgggaatcttagcgttgtattattactggtgctatcagttggggatattcccgaaaggcacggactacaagccgacaagcccgctgatgaaagaggagcttcggaaactggacgagattaccgcacaggtacgctatatgtcagagcatgacatctccaccctctccgatttgcacgccgacagggagaaaaaccagacggaaatggacatgcttaccgactatcggcggcacttgcagaataagatacggcgtgcttcacccgccgagaaagaaacgctccgagaagaaaaaaacggagtgacggagcagataacagaactgcgaaagcggctgaaatatgcggatggaattgaaaaacgctctgcccacattgatgattgtttaaaccaaatccacgatacggctgaaaaacagcgttcaaaccagaacgggagggcaggcaaaacagaccgcaggagggaggaatcattgcgatgagcagaaagtccgaagaagaaatacaggcaatcatggaggaatacagggacgcccctatggtaaatcccgataaagtatatccccctctgccgcccgtccaaaacgtcactccccttgtccgtgttccagagcagatgagctttaccgagaaaatcggcggcacggaatacaccgtcgacgcccatttccgaaaggacgggcgggatttgctttccaagcttacggatatttttatgcgtggcatgcagggatatgaatgttataatgacggggattggagtggcgatgacggagcatagcagaccgcagaagaattaccgctttaaagcgttgaagtttgaggacaggtatggtacactgtacctacacttcacaataccgtgtctgctgtcggaaaggagaaccttatgaaaagacagcaggaaaaatttaccgccttgtactgccgtttaagccaggacgacggacgggaaggcgagagcaacagcattgtaaaccagaaagaatatctgatgaagtacgcaaaggaacacggtttccctaacccgaaattctatgtggacgacggctatacgggtacgaattttgctggggttagatagcgatactttttacatctaccatgttgcggcggtcatggttgacaacttgcgtcggctcctgctcggtatcaacctgtccgacaaagctataatggatttcgattttccgggtgttggtttcccggtctaattcatgtatcaaaatacggtcgataaactcatggacgttttcataggtcaattcctgtatgtcgctgtatttcccgacaatctgaataaaccttgatatatccctttttcgctcggtaacggttgcgatctgctgttgtaactcgtctatccttgcggcaagggatttcttttcgtcctcatagccggaagttagaaacacaaaccgttcatctgtcagtctgcctaatgcgttgtcctcatacagcttgcggaaaagcgtgtcaagttcggtcatacgcgcctgtgctttgaaaagttccttttgctgctgcgctaatgcctttctcgcttccatgtcgccgtactcggtagctttacagataaagtcctgttcgtgttccttaacataccgcaaaacccgccgcatatcttccagcactaaatcaagaagtacgtttttgcggatataatgagaggtacactcgctgcctgtccttgccctgttgcgccatgcgccgcaagaataggaaaacttgcgcggctcgatatttacgccctgttggtaatacatcttatgtctgcaaccagcgcaaaacagcaagccggaaaaaatatcaatctccgctgcttttgtcgggcggtggcgggtagcaatccgcttttgcgcaagttcaaaggtttcctcgtcaacaagcggctcatgggtgtttgggaagaaatagcgttgttcttcttcgttcttccgggtctttttcgacttgtaggataccttgtgagttttcgcggttatggtatgccctaaatattcctgccttgctaatatgtcatagagcgttttgtccggccaagtatagggggcgatcattgcccgctgataccgcgcctgtcctgtacgctgatagcgcaacgctccaatcgtcaagactttgttttccgcaagccatttttggatttcgcacatacgcacgccgctaacaaacatagcgaaaacctgtttgacaatcggcgcggtttccgggtcgggtataaggtggtggcggttgttcgggtctgggatatagccgtatggatattccccgttgacgcgctcgcctttttgcgcctgtgcctgtttaactgcgcggattttcttgcttgtgtcgcgggcgtaaaactcgttaaaccagttccgcaagggggtaaactcgttatcctcccgcgctgtgtcaactccgtcgttgatcgcgatatagcgtactccgttttcgggaaatacaatctctatgagttcgcccgttttcagatagtttctgccaagacgggaaaggtctttggtaatgaccgtcgccactcgtccggcttccacttcctgcaacatcgcttgcagcccctcgcgctcaaaactcacgccggaaaatccgtcgtccacaaaaaactttgtgttcaaaaaatggtgttcgtccgcatagcgttgaagtatcattttttggtgctgtatgcttccgctttctccggcttgcatatcctcttgacttaaacggcagtaaagggcggtgattttattcgactgtaacattagtcctcctttccgacagccgaataaacaggtataatgtgttgctatcattataccatatcccgccgcctaatgcactactcggacgctaaaaatcccggatttccgggctttttctgcaaatcctttacaatgagtttctcaatctttttatggattgtatcggttgccttttcactcggcaacgcttgaacaagataggtgattttccctattttgcgttcggttgtaattgtctgttttttatccattagaaaaacctccttttcctgtatggataaactatattcgtcaaaaggcaaaaacgggcggttgttagctgcaacctcacgggagtttcaccccggcccatgcttatgggtgcgccgcgcaatactttgagggtgttcaacgcgggagtatcattgtgccgccttgtatgtcgtcgcccacaagctgctaaacctgttttacggcgcggtagttctcgctcggcttttcccctatggggaaaagctgtcatggcgtacccgccgactggctcggtacagacggaatgtacccgtttgcctgttatgctgcgcaccaaaggccgctttctttgtcaaagaacaataggctttgtcggcctgcaaaagcacatcaacagcggatatgcttttgcggaacgacaaatagcccataacgggaagcgtggaaaggggacacgctccccgcatgggctaaaagattatcctacatgaaaagcaagggtgcgggtaataaggcgcacttgcagcctgttacgcatttcctcgtccacataggaataggtattgcccgcgtcgtctttcagcgtgcgggtacaaagtttcgctatgtaaccctcgtagtgcttcaagatcgcgcacatggcggttgtgtcgccgtttgccgctgcggaaatgacagggaacggcaacagattttcagacttcctaacggtattcatcatctgcttttccctccaaatactgtttgattttcgcaagcgcggatttcctgtgccggaaaaccgtcgtgcgtacaacattcagcagttcgccaatttccgcgtcgctcatatccaagaagtaggacaaaaggataatgtcgcgtttcctttcgggcaaagcgttaagggcttcggcaagcagttcatttttgacgagtacatcaaagccggacacttgaaaacggaaataatcgctttcgtattcgtccgttgtgaaaagctgcgcgagttcgctttcgctcaaatccgaaaaagtaacttcgcgtgctgcgcgtttcgcaagagtgcggcggtggcttttcgcttcgccgaccaaagttttctttgctaatgcgtcgtactgatgttgtattctttccttgtcggaagaagatagctccatagagttcacctccttcccgcgtggagtagaggacgggagttaagggcttgtcctctctgcccctttcgctccgtacccgttcgggagatggctcttgagtgcgcttttcagaaaaaagttgaaaaaagcaaaatgcgcccgtccgcaagacgcggacgggcgcaaaggaaatgtaagcagtagctaaatgtattgacagttcacattcatagccggaatatcccgcttgcggagcatagctttttttgaccgcaaagcattaggcgggttacagtaaataaaaatggacacggcgatacctccccgataccgccgtatccttaaaaaagggcgactttaatacactacccgcaatccattctataatagggaacagcggcttttgcgcaatattaaataaaaaagccgataacacataggttttttgacctaatgcgttatcggctctgcgtctatgcgtctggcacttttaatcatttttttttgaatttattatatgtgttagctaactgtccacaagccgcgttaatctctctgccatgagaaactctcatagtaacttcaagtcctgcttgctctaattgatgtttgaatgcaactatttcccgtttctgtggtgctttaattcttgaattgcttgttgggttgtattgtaacacgttaatcataacttttttgccccgaaaccattttgcaagttgtcttacatctgagggccggtcatttatacccggtaaaagcaaatacgcaaagacaattttgcgattatgcctttcagaataggataaggcttgcttaacaacatcttcaatagcatatatgcgcatgtgaggaataatacgatttcttgcagattgtgttgctgcgtgtaaagatattgtcaactgaattttaagatgttcctcgcgcaatttttttaattgatcgaccggaccaactgttgatatggtaatgccgtcggttggaaagttgagcccatatctatctcggagaatatggattgcttttatcaagttgtcataattgaataaaggctctcccatacccataaaaacgatacggtttacttttcgacgcaacaatataatctgttgtacgatttctgacgatgttagattacgaacaaagccatttcgcccggactcacaaaaaatacaaccaacaggacaaccgacttgtgtgctcacgcaaacagttccaccatctcgccgcttgataaaaaccgtttcaatgtatttgttgtctttcagttcgtaaacatacttttcagtatcactgcttttgcaaatattttttaccaacattgatagattttttttgcgtggtaattgcttatataattcttcatataaggcttttgcttcattctcgccaataacttccgacatttctttgtaagtaaatccgtatggatcattccgtacttccgcaggcgtatatttaggtaaacgtttcatttttatatcctttcttctaaataataaaagtttgtttttctgtatttttgattacaatctctaatttttctacatcaatgatatgcgtcaatttgcatttagggcagaaaagaggaaaatcttttaatacagtattatgaaatacttgaactctcgtctttccgttacaaatcggacattttatccaatattttttaagcattatatttcactcgtcctttttacacaaaaaaatgcaggtcaatcctcaacatgagcattgacctgcatttataatgcacagagcagtacaacaaaactaaggcatagcttgcactatgtctatactatatctatacgtcgttagttttttgtatagcatccgcaaaataagcatgacaaaaaagcccatgttgaaaatgggaaaatcctttttttcaatgcttatctaatacgcatgctatgcaacataaacgccgcctccttttacataaattttattttatcagaaaatcagtctactgtcaatacacaacaggaagtatttaacctaatgatatgaattgtgtggacatatccaaaaagaaaggtgaactgtaaaatgtaacagggtgaatgaaaatggcaaaaagacccgtaccattgtacgactttaaggctttcggggcagctataaaagccgcgagaaatgaatacggcgagagccgcaaaaaggtaagcgacgagttatatatttccccgcgctaccttgcgaatatcgagaacaagggacaacagccgagtttacaggtattctatgaccttgtaacccggtatcatatttcggtagatcaatttttcttcccgaacagcaatgcggagaaatccaccgggcggcggcagcttgacgcgctgctggacggtatgagcgataaaggcatacggattgtaaccgcaacagcaagggagataacggaagtcgaaaaagcagaggattaacctcacaatatgagaaatcgggagattgcagcgcatggcggctgcaatctttttttgcgtccaaaatcaaaggaacgcgcaacaaataccgcctttcggtgggggtatggagtagatagcaagcacagcaaacgagtacccgtttgcggaaaatgcttgttgggataatcccaaacccttataccgaaaggcggtgcggaaatggaaaaccgaaagagaaatatacagatgaagttttacgttacggaagaagaaaagcggctgatcgacgagaagatgaagcagcttcccataaagcagtatggggcatacttccgtaaaatggcgatagacgggtatattcttgtcgttgaccgaagcgacacaaaagcatatatccgggaactgcaagcggtgagccggaacatcaaccaaattgcaaaacgcgccaatgcgacggggacggtttacaggcaggatatagaggacattaaaaaggcggtggacgagatatggcggttacaaagacgcaccctattaaatcaccttatctaaattttttaatgcgtttaatagcgaaaccattatccccgtatctatacatgcataaatatatgccattccaccatatttaggcatcgaaacatctgcatcgtaaataaaatatatactaaatgctgaatgtgaaaaaatatccttattcataaaatattgagattcctcgtttataacgttctctttttttattttctgtaaacaatttaatttaggtgaataataataaagtccacccggtatttctttaattctgttctctttaatatagacataaacatcaataggatataatccacctgcgcttgcataataataacgatgcgtaatagcatccctttctcttaaaatagatattattttgaaaaatttttccttatccatcagtgtttcattgtcaaaaacgcgaacactttttctcttttcaatcatatgagaaaaattgtttgtgggtatcttaatttcatccattattttttgttccatgaccggatttctagttaactgtatttctttaaaattctccagagtttccgcatcatatttaattttttcatcatacttattatcaaaaagataattctgtatatgtaccagttgttgtatctctaatgggctataaatcaaaatctgtcttttaattaaatctcttataaatttcttaattaagggattatttttataactcattttttcaattaagtcttcttctaaaatccctttctgtgtataaaagtaaaattctggaaataatccagaaaactgctgaccataattaaataattcaattttcaggcagccgtccacaatttcccatcgaaaaacaggcgaccaatataataatttattcgtatccatcttatctcctttataatagctaatttataatttccttttctaattcttccaaatattttgtatagctatgtggaaaaaaatgtcctccactaaaagaagttatcttaaattcttttaatgttacttctttccatcctagcataattgtttcgtttgcctctatatcttctgtaccacaatgagcaactatagaagaatttatcatttccccatgatacttaaaaccctcatgtaaaacataatcattcataatttccggtaacatatattctctaaaaatatcgctttctaataattctcttggagttcctcctgcattttttagttcatctaataatgcacttagtcccatactgcttctaaagctttttgcacacggatcaaaaggaggttgtcttgctgcaacaatcaatttttctggaaaataattgtattttttttcaatataatacgatacagagaacgctaatgcagcgcccatgctatgtccccagaaaaaaaatggtctatcatctagtatggctattattttttcagctattatacctactaagttattataattattttctttacctctttctgaaagacttatgggaataatgtctattttactactacgatctacccatttagcaaaagttaagctattccctccagcatgaggaaaacaaaataattgatatggcttttcttttttcattctttgaatataaggaaatatctccatattattatctctctttctcaattttatttttcctttcatagttttatttttgaagcacgacacatgctacatattcctcgtttaattttatgttcttcaaaaaccacccttcttctattttgttattctcttttattatgtcttcactaacagaaaaagatttgaactctttaaaaagtcctattcctatcgcttttacataagcctcctttgctgtccatagattataaaacttttctatattcttacttttattaatatcctctatctcttttttagaaaggaacttatcgcttatacactggtattgaaatgataaatttattttttctatatcaactcctattcttttttcatatgcaaatcccataaaaacaaattctccagaatgcgaaacattaaactgtataagtcttttatcttttattggcatatgatatggtttcccatttttttcatagcatatttgaatatcaagacaatctacttctaaataatgtgctaatagtaattttgttaaaatttttcctgtcatacatcgcattctatcttcataaaatttaaaagaatatactcgttgttcttcctgtatagaaattaaatttttatatttatgtatataatcttctaattctttccaattaatactccataaatgaatttcattcggaagtaattttattctacttagtttgaataatctttcgttacaatattgtttaatacttatcattaattactttattctccataatttattttcgggaaaatacacattatcctccacattttataaaattatcctgttttaaatattccacaatttataaatccgagatatattgttttacaagagcatattgaggtattgtctgtgtaatccatgtattagccccaataatactgccttttcctattaccgtatctccgccaagaatagtagctcccgtataaatagttacatcatcttctactgtaggatgtctcttaatatatcttagtttctgactatccttagtagataacgctcccaaggttactccttgacacatttttacattctttccaataactgttgtttcgccaattaccacacccgttccatgatctataaaaaaacctttaccaattattgctcctgggtgaatatcaattgccgttcttgagtgtgcatattccgtcatgactcttggcaaaataggaatatctaattcatacaggcaatgagctgttctttgaaccaatactgctaatggccccggataagctattataatctccatatagctctttgccgccggatctccttcatatgctgctatcatatccgatataaccaactgttttaaaacaggaagtgtatttttaaactccactagttttctttcatcttcacttcttcccatatttagcaattctaaatactcctttagtaagttacatatttcttgctctatctttctttcatcttcctgtccaaatggacaatattgcgcataaaagaaaccctgtaataaatttataaatttttgaatccatttatcattaaagttcttatttatcatcaatcccatcttttctgtatcttccttactacctaatctttttactcattttacttttctttcctttgttggttaggtatttctaactcacatccaaaatttttttacacttcctattattagtccagtagctaaaaccaaatgcgctgttgcaattccttttgccagcaaagagaatccatatatccctaaaaatatagccattataaattcaatcgctaatattattcttgcacgttttccataaattcttgtctctatcttgtctagtttcttacctttagtatctattggtactaacatgaatataactaaaaccgcaataagccaaagaaagaaaaaagagaatccaatgtctgatgttaccgctaaatattgcccacatccgaaaacgaggaaaccagagaaaataatacagctcgtaggcttttctaaatgaattccccctgcatactgccttaaaacagtaaacggcagtaaaaagctaaacatttctatccagtttcctgttgtcgtaccaactatagcaataatggcatatatagctatcttattcagaagcaaaccgtaagcatatgtataaaacctacgctctttttccccaagaattccccgctggctttgtaaagtgaaaaaccagtcgattatcctttttcgcattaaaactttctcatcttcttaacttcgtccggttcttcatcctgaaaatataaccagtcacatgcaagatttgcggaacgtgctgtcaatttgagcgcaagcaaattgatgccctctaatacctttgtttttactttgtctaatattttcttcatgatttttgcctccttttttcaaaattctactaaaaaatcgcctctactacaattacctcggccaaaacggtaattttttgggcgatttttgcatcgtcttacttaattgtaaagattatctcaacagaaaactcctgttctcctgcaacaatcctcatgattcctccatatctttccaccagcttctttaccgtatgaagcccgattccatgactgccggaatctctttttgtacttatatatcgctccttctcttttattaaaggcacaatataattattgcgaaattccattaccaggaaatgattttcattccccatatacatattacaaatcacatacttatctttctctgtcttttcagcagcctcgattgcattatccaaaaggttccccacaatagaaatcaaatccaggtcttctataaaatctgttctaagattatttccaagtttgattttatacaatatgccttttgattcggcgacaaattttctttcacataaaatactgtttagaaccggatcagcgcagcaactataatttttcatttcctgtatccggatccccaaatgtcttaccatgttatccaactcaagattttttccattttctatcaagttcgctgtaatacaaagaaatttattcacatcatgcaaaaaagcccttttatcttcgtttactttattgatatatttctgattgatattttcagctttacttttctgataaagcaattccatcttttttacttcttcagacctttcaattaatttatcaaagactgcaaatatacaaatattcgtcattaacagcaatgctgctccaataggaatcatgatacgatttacaccggtaaaagaaatatgcgaatagtatatacacataaaaatgataattgtcgctatcggcagagttaacagcacagtaaacaatttattttcaatcgtcagataattcttctttcttgttatctggttaatacatttcacgagtaaaaaagtcatcgttttcatcagcaaaatagccaatgttttttccagctcagactgaaattcgtttgctgttccagttactccataggcttcagtaatcgcagcaaacaaaaactctggtatgattgccaacatataataacaacaggccatgataactttcttccacttactgccttgaaaaataataatggcagcaatcgtataacttacagggataatcgtaatattaaatagcgtcgttcccatatgatttgcaataaaaatacaaagtgccgcagcaaaatacaccccaattcttttccataaagatcctaccctatatggaaacatatttttcccaaaatcattcagcatccatacctgaaggctgcaaactaaaacatctcttagtaaatccatcagatcaaccattcctttccctcagatattcaaacagcgcctcggtaaactcttctttctttgctcttgaaacattcagttctattccgtatttcaaccgtagtacgcctttttctaacccttctacttttcccaaattaacaatgtaactataatgcgcctgtgcaaatccctgatcttttaactgttcacataattctccaaacgattctctgcaccgaactgtctctttttcttgctctttcacaatggttatcacacatcctcttttggctctggaaacatataagatattttccacatgtatgcgtattatcttccccgccgatgtcaccgttaccgcatagtcattcagaaagcgtctctttacctcagtcataatagctgcaatttcccggcgtaagctggtatcgtgtaagtccttcataatataccggaagggctgcccaaaattaatactgtccactgtcggctcaaaataactagaacagaagattaaaactgcatctttgttataatttctcaattttaatgctgtttggtttccatccagccccggcatacggatgtctataaagaccaattcgtggagaatatccgtatgtttcaaaagttcatttccagattcgtattcataaaatctgatttcattttcatgcaaactattttcatgctctacaatctccctgatcgtttttctatatcttttatcatcatcgcaaatagctatcttatacataatccttccttttgttagttgcaactaacctcatttcataaaaaaaaccatcccgcagaattttgccatgagattatctcttacttctataactccggttccaactctgcaaagatggaatctccaaaaaattctggtattgtgatttctaatccatcacacaatttcttgattgtaactacgcctacattcttactctgcccatacaaaatattcttcagcgttgatggcggaacaccagaacgtatcgccgcctcattcacggtaatatcgttttgccttatcaattcttcaagacgatatataactgctgttttcatatccatgatttctaccaccttttctctattctatataaattgcccgtaaaaggtcgcccatatatagtctttttgaacaaagatacatctttgtaagctttgtatactttcgtggtagataattcagcatttttaccaaaacaaaaaaagccgaaagccacattgttatccgtgacctccgactcctttctatctcatactacaccgtccttacatccaaatcagcccctctctccggcttatcttttccctgtttttcctgaatgattctcttattgatttccaagcgttcatggattgacggttttttctctttttctgtcattgctctcttttgtgctactggctttctttcagctttccctgcgtccttaactgctgtatttgcttcaatgccagctcttggcgcagcttctctgctctcagttttctctgctacctgctgttctcgtctctcctgcacacctttttctttcaggctgcaaaagctctgcaaatacggcaacacatgattctgcatatccgtcagatcttccatatacttctggtactcttcattgccttttccttgctgatagctgatccagctttcatctgtcagtttcatttcattctgcatctttaactgactgatgataccgccgtttccggtaccaatatctatcttaccttgaaaatggtgcaacatcttgtcacctttctcagcataatatactgtaaaaaacatctgtgctgtcgtttttggttcgtttgtgttttgatcacgatcagcataccaggttttgtcctgttctacggttcttgaatccaaatcagataacttctggcatcttggcttccctagctcacttttctcacaataattcacatacaccattggttccatatcttttggaagctccggttcataggctttcagcctttcaatcaatatacctgcacgcacagactggtcacatccttcatctacaatatccttcagatacgaaatataggaatgaatattcccgcttcgcaaatccagcattacttcctgtaccgtattttctcctatctccacattatcccgatactcatacggatcaaatgcttctgcaatctcatccaatgcctctgccagctgttctgtggtcatcttctcaggatacattgcttctcgaacatcccgcatcggtatatacttatagtccggcaatgcttcatgaattttctcaatcccttcccgtaccagtgcaagttctccataaaaccgaacatcatccatcagatttccaaatacagtatttccttttacgattgcaaattcggcttcatcgtagtaactgtcttccggatcacgatagataattcccattgagcatccgagataagctgtttctggattctccctatatttttcatagactgcagctatctgattaacatcggtacttttttcatatgctcccatatcgtgaaactcatcgcattctgtggcgaaatattccagataaggttctttcttcggtgacatattattaaggacgttatcaatcatattataatttgcctcttccagttcctccaccttcgccaaaggcttatattcgccctggcttttctgaatctctgccattacaacctcatccatttcttccactttttccatcaactgatcataatccccacggatgcgttctccagtccagccttcgtcttccagaagttcctctgccgcttcttcaatagaattttcatcattttcatagacgccaccatccatcagacggaaatcttcatcgtaaaaggaataatcgtatccttcttctgtcctctgaatagcaaaataccgttctcctacctcatatgccagttcactaagaacctgttcttccagattcaagaaagaatccagctgttcaaaactgatactgtctacaaaatgagcggttactttttccccgtcattcagaactacgatatcactgactgacagggaatgcccacggaaatcttccggtctatcaatgttgaacctttcaaaaatatcatccagtgacatatttcccagtaattcgccaacatagaccagcttataatcttctttttttatctgcataccatgactttcaataaaacgcatattcataaatgcatagttttcgcccggtgaatcatccttgatctgataaataccaaaggttcgccttgttcctaacagcaggtttgcctcttttaaagactgaatctgtggatatttttgcatttcccattccaggttacgaaaacgctccagttctgtcctagacatctgataatactctggtcctcgttcaatttccatgcgttccgtgacatagaccggtgaagaaaaattagtgatcagataaatatctgctccggcatcgtataatttcagtgcttcttcctgctcaatgacactcataggctcctgaaatgctccaaaatcttcatctgcataatccagatcctgatcccttatccgttcccacatctgtaattccatgccaaacagcccttcgtgtgcctgtatcatttctttacttgcatactctcccttaccgccatcgctgcccagacaataaatcttagaacccatcctgtgataatctaaggctgcttcctttctaagcggtaccatatcctctgctgtatatccataatcctgaagttccagcttgcctatggttggatctggtaagtcctgaatatccattcttgcatcatccagtaaatcctctacactttcttcatctgctttgctcaatacatctgccagatttcttaccagagtcctaaccttctcttcctcaccgatcagattcgcatattcaaaaagctgttcttttacatctgttgaaatttctatacctctacgctctgcctgactgatctgttcctgcgtatattcctgcattttctgtgtttctctacccgttatcctgtttcttgccatataaactcctcctgtgttctaaaaaatggcataaccggcagaacattctttctgccaaattatgccatctttcctgtttatttattccagaccgaagtcccgttttctagtttcctttccagtttcactttcccgctgactcttttctttataaatctgcagtttctcatggatagaacctcgtgccggtctttcttctttctcttttgattccgcttgctctgtttctgtatcttcccgttcatccatattgagaagtgcatttaattctgatagccgctccagtttttggttcagttcctcttcttttgaaaatggcttcccgacttcctctttggcatttgccatctgctcctgtaccgtttccagccgttgttctgcttctgccagtttctccggataactttccaaaagattattgatacgagtgatatttcctagagcatcggctcccaaccgaactttagctaccgattcatactttacagacaggataaactctttgctccagctgtcgaattggattctcatgttaaatccctgatagcttccaatgtccatagctgcatctacagacttaatgtctttgcagaccgccagaagtgccgcacctgcctctttcttttctgtgaacactttgccactgatttccatagaaaactgctctggatctgtgattttatgctcagaaaaatgagcgatgtctgccttgtagctgtcaatgatctctgtcagttttgcaatctgttgcggaaaattccttacaatatcatcttccaaacgatactggttattcatgtgattggcttttaaaagtttcagctttgccacatccacgtccagtgccatcttctcctttactgccggatttccagttgccagtgctttaacctctgcataggaaagtgccgcttcgtccacatcttcgcagcttctgaccggtgctttgctggtcatgatctgggaaatgaatttctgcttgttctcgatcagctgccacatgtagctgtcgaatgtggattctgttacatatcggaagatatgaacctttttattatgatttccctggcggataatacgcccttccctctgtaggctaagtacccagcgccttgccatattgctatggtaggtttccaaatactcgcccccgaaccgtacttacaactctcactgtatacggctctccatttataaactcaatttaactgtccacagtgtaatttcttatgacattctctacacaaagctattgttttgcgatttctcgctatcataagagcttcccaaaaagttttaccttgtaaatctttaagccgatgaacatgatgaatttctatgggagtattagtttttccgcatagctcacattctctggcttttattctgtcgattagctttgtactgctgaaatatttgattgtatttggaactaagtctgcattagattggaatgcttttttctgccgtttaaaaccctcgttataaaacactcgcattttctcaactcctttggaattacggaactttacagcaaaatcttttcctgctctgaattttccgattacttttgaaattgatgttctgtattttgtgccgtaggttttgtacatactgtattccataatatacttgtagctgttgatgattgagctgttattggctatacagtaataattgtaaaaacctcgtatcatactgttgtagtagtcgagtatttccagatcatcacagtttttcaatctgtatattgccttgggtttccaaatttcttttccattatggtagattaacttcatagcacctgtatcaatcaagtgtttcctgattgtatcacttgaaacttccagtacaattctgcccgtgtaattacgaacgagcttgcctgttttatctctcttggttagattgctatgccgtactctgatttcataactgagaaatttcgcacttttttgggcattggtaatcagcgttttctcttctgatagctccaactgtaattgttctttgagaaaattcttaaaatcttcttttattttcttacaatcctctttcgaaccgataactccgcacagccaatcatcagcatatctgacatagaccagccttgcataattgttatccatagggtcacttgggggaatattcacccgttctttttccaactgccttatgcgtgcaatcgcattttctctttcacagtcgtcgtttgcatttttcaatgcgattctggctttgcttaattcgacttcgttcctgcggtactcttttgtacgcatacgctttttaccttttttaaattttcggacatactcatttacatacttatcaaatttatccaaataaatgtttgcaagaataggactgataatgccaccctgcggtgttcccgaataggtgttatgaaaagtccaattctcaatatagcctgcattcagaaattttcttaccagtcgaagaaatctctcgtcattgatacgttctcgtaaaattccaatcaacgtagcatggttgatgttatcaaaaaaaacctttaatgtctccttcgataaaccatttcacacccgtgaaagttttttgaatttcattgagtgccgtatgacagcttctattaggtctgaacccatgagaagtattttcaaaatgcccctcatagatagcttctaaaatcattctgataacctcttgaagcaatttatcctcaaaggacggtattccgagtggacgcatttttccgttcttctttggaatataggttcttcttgcaggttttggctgatagctttcatctttgagcgaaactatgattttccgtattctttcgatactcataccgtcaaccgtttgcttgtcagtaccttttgtcatacttccgtcattggaataaatgttttgataagcggttaagtacagttcctcattgtagagcaaacggtataaacgctcgtacttgtaatctttttggttactgtgtttcgttaagctgattaacacattttcaggatttctcataatgtatcacacattatcctttctatattgttaatgttataaactgccttccttcgccatgtaagtgccattaacactctcggactactatgaaggctccgttaccatatcgaatattcataagcctacacttaatagcttatttttaagcgtttcgacttaggtaatccccgtttagcatcatactaacgatttggcttgttaggttgtcggatacgacttccatccttttatgcttattgcatatacgtctcagcctatctttgcttacgctcctgaacagcggaacataagtgctgagatatggcgaataataattaccttacgccatagtcccgacattgaccgtttggactatcgttcaaccagtatgggctttatcctcatacctaacttttcatctccccattcagtcgcagcttggtaattagctgacttatggctttaccgacgtgctattttccctgatatttagtttccctcacaggtaaatcggttgatgataggactgtaagatactatcctaataccttgccaaaggtatatttattatgatgcctttacgggcgcacgttccaagtcagatggtttccagccaatatccagatggtgcaacgcaatcagacgatcctgcacgttggtcccggcacccatctttgctgtcgaaccaatcaaaaaacgaacctgcccggatttcacttttccaaacaactccgtcttctttgcttctgtatttgcatcatgaatgaatgcaatctctttttccggtacacctttttccatcagtttctgcttcaagtcgtcataaacattgaaactgccatcacctttcggtgtgctcaagtcacaaaaaatcagctgtgccgatttctgtgctgctgtgtctttccagatctcatagcttttctctgcacagactgctattttgctttctggattatctggcaatagttcgttcaccaaacgctgatccaatgctaattttcttccatcattggtgattttcagcatattatcaactgaggcatctacccctccgcttctgacaacttctgcacgttcccccagcctttctacgatttctttctgctgttccgttggtttcagcaccactgtttcatattctgcttccggcacaggaagttttaactgatcggaagtcttgatatctgcaatctccttaaacatattcatcagttccggaatattataaaatcttgcaaatcttgattttgcacggtagcctgttccttccggtgcaagctcaatgctcgtgactacctcgccaaaggtggaggcccaggaatcaaacagtccaagtcccatattttgtaatttgctgttctgcagataccgctgcataacatataattccgtcatactattgctgattggtgtgcccgtagcaaaggtaatgccttttcctccggtaatctcatccagatactgacatttattgaacatatctgcggatttctgtgcttcgttctgtgcaatcccggctacgtttctcatttttgtataaagaaacgcatttttatagctgtgtgcttcatctacatacaagtgatccactcccagttcttcaaaagtaactacctgatcttttttctctttctgattcagtttctccagccttgtctgcagtgtttttcttgtcttttcaatctgtttgacggtataacgtccaccatcctgttcatatcttgcactctggattgccatttccagatcatcaatctgcctctgaagcatggcttcttgtttctcatcagagattggaatacgctcaaactgagaatgaccgataataatggcatcatagtttcccatagcgatcctggcacagaactttttccggtttgccggttcaaaatcttttttggttgctaccagaatgttcgcccctggatatagctgtaggaactcagctccccactgctctgtcagatggttcggaactacaaaaagatttttctgagataatcccagacgtttgctctccattgccgccgctaccatttcgtaggtcttcccagcacctaccacatgagcaagaagcacattatcaccatatagctgatgtgcgactgcatttttctgatgcggtcgaagttctatttccggattcatccctgggaaagtcagatgacttccatcgtattcacggggacggatactattaaaacgttcattgtacacgcttaccagtctttctctcctctgctgatccttaaaaatccaatcttggaatgcagcttttaaggcatcctgcttttgtgatgccaacatagtttcttttttattcaaaactcgcacttcatccccattttcatttacaactttatcatagattctaacatcttttagattcaaggtatcttccagaatccggtaggcatttgctctctccgttccatacgttgcataggcaaacgcatttcttggactgtcggcgttctttcctgtaatcctccactcaccatttacctcagagaattttacctgtatttccttctgtgcaagatacctcggtgtatgaagcagttccaccataaaatcctgataatccgaaggttcaatccaggtggctccaatacgcacttcaatctccgacgcttccagatctcttggctgaactgcctccaatgcacgcacattcggtgtgaattctggatgattctctgcaaaagttcttgcaatatttaatttatccctaacatttccggagagatattcatctccgctttcccactggtctgtcagtggatttttgaagataactccaaccagctcttctgtgattttctcttcggtctttccggtcaactgtgccatatatgggagatctacttgagccttttcatttagggacagagcaagtgcttctgtggctgtctccacacttgtcacagcgaccgcctttttaatggttcgtttggtgaacatgtccgctttccgcttcaatgttccatcttcattcaagtcttccagggaacacagcagacaataagaagagtcatcagaaaatgcacgtttgttagcattacttccaataactccatactttgctgtgtaggtatcatacacctgattcagttttttctgctgtttctggatttcttcgtctgtgacaaattcttccatctgcatggcgatcagttcacgaacggtatcacggattgcaaccatgccttttacacgttctgcagtggctgcaggcattttcacctgattcatcaaagaattgacacggtaatatacctgatcatctaccaccgtatagctgtaatttcggacattcggatctgccggaatactctctggcatctcatccagttctgcctctatatctactgccgctaccatgcttcccttgatgtgttttacagcttcttgtaactgtaattccagaacagctccttccattggagcacaggttgtttccataccatacggaccggacacttctttcatctcaccaagaatcattcccggatgctgaacaaaatacttgttaatggtaatcccttttgcatcactctccaaattcacccagtctggcatctcttttgtgaaactctcacgcttctggaaaaacaaaatatcagcactgacttctgttcctgcatttgccttaaaagctgtgttcggcagtcggattgcccccagcaagtctgcacgctctgccaaatatttccggacttgcggtgatgccttatccatagttccctttgttgtgatcaacgcagctacaccacctggacgtaactgatctatagtcttggcaagaaagtaatcatgaatcataaaattgtagcggtcatactgacggtcattgaccttatatgcaccgaatggcacatttccgattgccacgtcaaagaaatcattgggataatccgtcttctcaaagcctttgatctggatattggcatctggatagagaagtttagcaattctaccactgatgctgtccagttccactccatagagtttggactggtttagattctccggaagctttccaaagaagttcccgactcccatagatggctccaggatatttccctttgtaaatcccagattctccaacacctgatacatactttcaatcacaatcggctgtgtataatgagcatttaatgtggaagctctggctgcagcatattcttccggtgtaaggacggtctttaattccagatattctgtctcccatgcagattttgtctcatcaaatgcatctgcaagacctccccagccgacgtacctggataagatttcctgttcctctggtgtcgcattgcggttctcatcctcacatttttttaacagctgaatagccataatattggctcggaatttctccttcggtgttccctgtccaagttcatcatctgtgatatggaagttcgttgctggaatcagttctgctattccgttaatctcttccaatgattctttttcttccgatacctcaacttctcccgacagttctttttcttttttatcataatctgtccacacacgtttagaaatagcagtaaaataggaagactcttcctccatgatttcttccttgatttcccgtaatttatctaaggtatccgcatttactgttttgttgtgataatgataataaagtacttcttgtccaagttttacatccagacgttccaattcttgtgttgacattcgctcccaaatatcatctttttccgtatgaatcgtgaaaccttctccatcatcatgatattctaatgtgtattgaagtcgattctcttctcccttaactttgcaagcaaaatcatagatttttgttctggtaccggacatatattctgaatcaactagtcgcagatccgttatatcttccgctgtaaaagtatcctgttccagctgttctcctaacatctgctgtgcttcttccaggtctgccagtctttgtgcttcctgtcgctcttcgtacttttccatttcttccggtgacaaataatcatctgtgcggattaactggcgaacacgttctgcaaccttattccactttaataaaacttctacctctggattgccaatcttcccttttccaagctttaatccttttgcatcgtgggatgcgtcagaagcatctgctcctggtattccgggtgaagaaccacctgttccatattcatttttcaggaactcagctgcatctttcatatcatggtgctccatgaaatactcatagattcggttacgtcctccggcagtaataccgcctcttcttaacactgcatcaatttcatcctgtgtgataaaggatagagccggtcgctctactttaaactgttgatccacccaggaacgctccctctggagatctttataacgttggaaatattcaggattatgctggatttcccagcgatgataatcttctggattcttttccatatcttcctgaagccattcaaaacgataggctgtcgcagctgcttcttccgaatctgtccaagccgcccctactacatcctgccagtcagaataagacaaccgttcttctctgtttctgctcgtatcacggaaatggagtgccagaagatctgtcatttctttctgttcctgctcgatagcattattggagataagattatcaacgtaatttccctcctcatacatatctcggattctgtcagcggcttcttcccacgtaacgatacggtcaaagtttcttctggcagaatcacctctccggatacggataccatcgttgtcgtaccagatactgattttctgaccatctatggtaaatccttttcctccagttctatattcatctttcaggaagctttgcatttcttcattgtccagaccctcaatcaatcttgcagtaatgtgaaacagcgtatttttctgtccgcttcctgttcggagaatatcgtctaccacttcatcagaaataagaaaagcggctggctgttctaatgcagctgccgctttccttatttcccctaactgttcctcttctgttgggaacaggcttaactgtaaataatctcctgaatcaccagttcctctgcctgtgctttgatctggttcatgtgtctggtccacgccattgtgtctgccatcttgtccggtgccggatctttctccagaagttcgttcatcaggttgtctactctctgtcttgcctgactgtcgatctccatcagatgactgtccagacggttctgcagagtcagaatgttgaaccttgctaccttgtgatttctcagatactctttcctcatcattccatacttcccgatggttcctctcgtctcttccaggctgatatctggaatctgatactctccgttctggctgtaagtgatctctctcatagtctgtttcctccttattttcttctctatcttctgttttatttgtactgttttcacgcattaacgtgttaaattcattatagactacttctttttcttttgcaaccgttttcaggtcattttccagattattcagcacatatcgtccaatctgcatcaggactggtctgctgatctcattgactgcacttcccagatgtcctaatactatcagctgattaaagtccgtaatatgccgaaaatcctctgcatccagatattcctgtgcatccagtccacaccggtttagtaatacataccagacactattggtcatcagttcccgaaattcgacttcctgattctgttcgtccagttcttccagaaatgtccctgttacgtccagtctcagttcttccaatgcatctggaagccattcttgcatactctccttcgctgcctgatgcagactttcagcaagtcctccttctgtatcttccagtgataactgctcctgcagataatctgccaccagctgttctccttccaccggaagattccataactgaggatcctttccaagattccgcactttataagtgtcctgcacatcaaatacataccgaagtttcgttttcggtccggaagtattgtcaatcaaggcaatccctttggatccctttttgatccagcggtacatcttctgattccagatttccatggatgctacggcagttgcttccggtcgctgtgcataaattaaaagctgttctggaaaagtgtatttgtacagtctggatgcagtgtttaggaaccgcatccattcctgcggactggcagctacatcttttgccacctcttccgtcagctgttccattgcatataatttatttgccatgcgctactccttttcataaaatcagggactgcttagcacagtccccttaaaatcatcgttgttactctttataatgctgtggcaagctcttttgacttattctttggcactttgtctccctcttttgccttgatttctgccttagctttctccagtcttccatggattccaccttttacttccgctttttcggctgctttttctttctccaaacgagcttccctacgctcagcattttccataactgccgttttcccatcacaaaactgaactttatcggaaagctgctcctgtctctccacctttgtctcattgacttcctgtaccatcgcatttaattccggaacctgaaaaatgccgttatcaggaagaatcagcacttcatgaatggaagatgggatgacaaagtaatcacttcccaggcattccccaatctgtttacgaatatcttcctgcagtaacagggaagctccattcatcttagctttgtttgtcagacagaacattgggttttccatggcttccatatccattttttcattcagcaggttttctggttcttcaccaaaaatcatagatttgataatctcattcatatccataagtgtgacaccacgttttcggtctgccaccatcgcatccgctagaatctgttcggcagatactccccactcgttcatcagagaaacagttaccggaatactgctgatcccttctccattttcctccagatttactgcataataagctgcaaaatctccgtgttctgtgactactttatctgcaagaagatcggtattccattccttatcacaaattctcatctgtaatttgtccttcatcttttcataatccagaatatctggaactcccatatcaaaaaattctgcttttccctgtgcctcaatacgcatatcagccacatcgctaacacaagagtctacatcttttccatggatatattcctggtagagggaatccagatagactgtcggtacgattctctgatctccgtttggaatcgtaatacctgtcagcttcaaaccgttgtttttttctacttcctgcagtttaatttctgcgtccttataagactctggcagatactcctttacattgtctttgacatattcataaaattcttttctgttcatcatacgcttttacccctttctgatcatgtgatggttcactctttttctgctgaccatctgctcggctttcttctgataagccatcattctctttaaagttttctcctggttcttttttgcttcctgtctttttaccattgttttcatcatagttttctgttcctttctttcattagttgtattgaaaagggagccctgattcagggcccccctttactacaaattaattactttactattttctgtttttcttttttctgatataaagtcctgccatacctcctgtggagattaccagaagaagaatcggcagccaaatattcgtgctgtcacctgttttcggtgcatttgatacctttgtctcttcatgggactgtggtgtatccagtgttttcggtgtttctggaacttccggtttctcatttgtcagattaaaggtaacttctacaaccggtgtactgtcatctgcataggcaaatgtcacttcatgcttggtctgatccagtgtgtatccgtccagtgtctttgtttccaccagataatacttgatagcggtatcatatttgccgttcttaaatgtggcaatctcatacagcttactttctgcatgaccggcagcatctgtctttaaggtttccagaacttttcctttgctgtcacgaagttcaaattctacccctttcagcggttctcctgatgatttatctgtcttattgagaatcacttttcccttggcagtgtcatctttcatagctactttctggatctctccagtatcctttacttcaaaactaacatccgatgtcagaatatatcctttcggtgcctgctcttcacgtaaggtatatttaccgattggaagtttttcgatatagtgtgcttcctctgtggaagtccagctctctactacctgatcatccttatcgagaatcgtcagtttcgcacctggaatctcagtttctcctgtgatatcagtcttactgatctctacttttgtcacatcatctttcatctcatgcttctgaacctctgctgtattctctactgtgaaagtaatactttctgcagtgacatatccatctgccggttttgtctctgtcatggtgtatttcttaccaacaaccagttctttgatcacatgggattcttccgtagaagtccattcatctactgtattgccatctgaatccgttactttcaggtgtgcacctggaagttctttacctgttgtcaggtctgttttggacagctccactgtggttggctgattttcaaaagtaaagtcgtagcttacttctgcctggtcttctccggcatattcaaaggtaaattcctgtacttcttctgttgtaacaaatccgtccggcgcaaagatttctttcacatagtattttccgtctaccggaagatctgccgtaaaaataatctgtcctttttcatccgttacccgctgctcgatcagactgtctttctcaagaagtacctcgccctttgcatttttgatatcttcactggtataaagaccgaagacaccacctgcaagaacacggtctgtatctttttctttcttcagaaccgtaacctttactttctgacgggcattctgccatttctcatcataagtgatgactggtgtgtcctgatcacggtaggaaaggtcaacatatctcggctctttgtccagcacataaccatgggctgttttcacttccttcacatagtattttccagccgggagatctcccatctgtgcaataccattggaatctgtggtaatggttcccactttttcatctgctttgaaataatcttcactgacaccatctgccgctttgatatcttccgcagcaaatacatcgaacgtcacatctgaaaggcttccggttacatactcaaagagatgctccacggtaccttttacatgatccagaagtgttatcttatccagaaattctccatttttgttgatgatcagaagtcctgttggaacttcatctttcatctctactttctgaatctcggctctatcttccagcgtgaacttcacatccgttgctttcagatatccatacggtgccatttcctcacgaagagtgtattcctctccaactgtcagtcgtttgatcacatgtggctgatcttttacagaagtccactgatccacaacatttccttctttatcaagaacagtgagttttgctccatccagttccacacctgttgttacatcagattttgtaatttctactgttgtcggctggttctttttcactgttttcagttttactgtcttcacatcctgtccctggtaagaagcatccagattcagaacttcatcagaggatacaaatcccgccggtgcttttaactctttcacataatactgtccaagtggcagatccagcgtacatgttgcaagaccatcgttatcagaagtcatttcctgtaagagtgtgtctgctttcacgatcacttttccatctgccttaatatccgctttgttatagataccaaagacagctcctgctacggttgcaccattttctgcatcctgtttttctacctggattacaactttctggcggtcatcgccaacagtcacttcctgttcgattacaggtgtatcctgatctgcatagacaaatgcgacatccgatctgtcatggttcaggacaaatccttccggtgcagtcttttctactacatagtaagaaccaagtggcaggttatcagcaactgcttttccgtcttccccagtcgttaccgttgttaccagtgcatcttttgcatagatcagctgtctgtttccgttttcatctttctggtaatccggtgtatagatattttcagctgcatagacattaaattctgcacccttcaggtatctttcttcataaacaaaatctttcttaaatccggtcagcatctcaccttttttataaatcgtcagctttccttttaccggatggttctcgtaatctaccgtaataatggcatctccgctttcagaatccatctggtatgctgtgtttgcatccactgcaatctctacataattcttgttgattgtgtacccttccggtgcgttgacttcctcaatccggtaatgtccgatcttcagattcttcggcatgatcagatacccctgattgtccgtaaaataggacttatgggttgttgtcactgggtaagttgttacctgctcaacatactttttattatccaggtcatataccttaaattctgttcctgcaatcaggacggatttctttgtttcatcgtcttttttcacgattttcagttttgccttaaactctttatccagaagcactcgccagatctgcggctcatttggatgatgctctgtgatattcacttcaaaatcatcaactggcttgtaattgtgcggtgttgtagtttcacgcacaatatagcttccaaatggtaatggaatactgcaggcatatcctttgtcatctgtgaaaatctccgttgctccattttctccactcactactggtttggcagaatcaaaatcatagcttccatctgctttctttgtaagggaagatttcagataaactgtaaatccagctccggataacagatctgcatctgtctttccattgttggctgctttgatgatctggaatggctgtttgatgacctgctcactggaagcgcactctctttttacttctgctgtcatatctccttcataactgcatgtaagatcatgctcttctgcatctgctaggtatccggtcggcggagtaatctctttgacataatatttgccaagatataagccatttacagaagcctgtcctttgtcatctgttgtaagagaagctacctgctctcctgctttataaatagttcccgttgctccatccgggtacacgatatcttcacgggcatacagtccataaactgcacctttcagtgtggcatctccctgtggtactgcttttcctgtttctttatcaactttgaataaattgatctttgctgtcacacggtcattgctaaaggtatgggcaaatgatacggttgcttctttatcattggtgtaagaaaacttgaacgtatacacatcttctgtatttcttacatagccttccggcgcctgatcttcttttactgaataggaatatccaatcggaagatctgctgtgaattttgcagttccatctgctccagtagttgctttctcaatcagtgttccttttttcacaacaacggttccgtctgcatttctaatatcatcggatgtatacagagcaaaaataccgcctttcagtggtttcttggtgtctttatcctgttttactacagaaacatctgctttctgtctctcgttgttaaaagtcacatctgcaaatacaacttctttgttctgaccagcataagttagagtcactgacttttcttcgctgccgttatagaaagagtccggtgcttttgtttcttttaccacgtaggttccaagatgcaggtttttcagtgtgacagaaccattctcacctgttgtcaggttttcttttacaaggtcacctttgctgtacacttttgtaccataagcagttacgatatctgccccggcatacacgttatacactgcatttttctgtctgcggttttcatactgaaataccgttccattttcactgacctctgctccggtcagaacctgtccttctttgtaaatggtaagctctgccagctgttccttattttccacggttacagctgaggtcttacttgctaccagttttacatttgttgccgttgcatttactacatatccctgtggtgctgtgatctctttcagataaacagtatcctgtgtcttgatgatcgtaacagaagattttccattcttatctgttgccggcatctgagtgatcagctttgtacaagcctcatcgctgtatacaccgaatactgcacctgcaagattgacatccgctgtatcgtctttctttacgatttcgatcgtagcctgttcaatccaggacacctttaagcttacatatttttcatcagcaacaccttctccaaatacaaatgccagatcctgaacacttgcattcgtagtcaatttatatgctgaataatcttttgtaatacttcccttcatttttgcagaaaaagtagcacttacatctcttgtctgtgtcagaggagctgagagataaaacgtggttcctcctccaattgttacgcttgcacctgccgcacttacatttccagtagatacattatggagctttactccttttggtaagtccattgtgattttctgctgggaagatgcgttgaactgaatgttctccgttctctgaacatttccatctacataagcctttacatccggctttgaaaatgacatcgctacatctggtatttccggcttattcacacaataattatagagttcttttgccaaagcctctcctgtagcattggttccgtaaaatgcatcactacttccgttggcatatgatgcagccatatgaataatgatgaatctttttccttctgaaaaatccgtgtgtttattagcgaaaaaactctcgcttcctgcggcatctgtaccgtaataacacacttttgctaacgcctgattgtctccaatctttgtaattgtataatttccagatccaggtcctggctttgctggctgtacacaatacgcaattgctctgacgcttccgtagctgatatagtacggctctgtcagataggttccaagattataatctgcatatctatacagtggtcctttttcaattgttacctgctgtgtacttcttgctgaataagccgaaactgcttcaaatgttgcaatctctccttcttccatagcctcaagatccacaccttcgtctcctgcctgttccaaaacatcatgaagctctaaccctgattcttcatcataggtatcctgattctgtgcctgctctaccaaatcatcaaattcatcagcgtcaatatcggtaatctccgattctgcttctgaatcctccgcttcttctgtctgctgttcactgccagctgtttcggattcagtcactgcttcactccctgcagcctctgtctgtacttctgtttctttctcacgcacaatcaggtttcggctgatctggtacttcggatgctcctgatttaccggttccacataatagaccgctttgtaagtgtccgcatgatctgtcgtaaaatcctcattctttttgttctttgcttcctcaaatgtgactttgaccttgttatcatccttgatttccagtcctgtgtagtctgatttcacatcaaatacactgcctgtttcgatttcataatctttggcagtcaccacctcatcttcatccagaaggtctttcacttcctcataaagtggaggtttttcctctggccggatctccgctgcatatgccgtcatcggagacagcactgtactaagcattgtcatgcctgccagcaagccagatactacttttctaaaattaccttttttcttcatactaaggtcctctctttcataatatttgtattaaaacagacagtccttagactgcctgcaatacactacttatcgttgcggaaaactcagattgaactgcacatttccctcgccgggatcaaccatttccacagttgcttcatactgtctccctgtttttcttgataccagatccttataatggatttttcctttagacaggaacttctttgctgtcgtcttatccatccttttcccctggcttgcaaggaatttatcattcttccacaaggtaaaagcacaattccggtcagaacagtaaaagtttacttttccttcccggacatcagctccacaacggggacatttgccaatgacttctccttttgcctttccctgaaactgctctttcttttcttctgaaattccctggtatctggcaaccagttcctgcatcagctctgtaatcccatttaggaattcatctgctgtctctgtattctgggcaatgtggttcaatgccatttcccactctgctgtcatcttcggagatttaatctcgtccggtagaaccgtaatcaatacatttccatcatccgtcggcaccagatttttcttttcccttttcacaaagccagactgaatcagtttttcaatgattgctgcccttgttgccggtgtgccaagtcctttcttttctgtatcttcggtcagttcttcattccctgcacgttccatcgcagaaagcagggtatcttctgtgtactgtttcggtggctgtgtaaaatgctccgatacaaaagaatcacagggaccataatgcttgcctgcccagatatccaactccggctcttctttttctgcaatgattccaaagaactgtttcagttttttctcaattgtcttgaacccttcctgctttgttttctttgctgagagataaaacgtatgataattacaggtaatctggcatttatggctttcataaatataaggatctgcggttgctgtcagtaccctggcactgatcagatacaaaatcttgcagtttcgttctttcagtttacctatatctgcctttgctacttccacggtcgggataattgcatggtgatcagatactttctttgaatttaataccttactcacgtccggctgatattccagcccttcggcatagggcattttcccaagtaacatctgaatcagagtttctgtgctttctcccatctcatctgtcagatactggctgtctgttctcggataagtgacaagtttctgctcatacatctcttgcacggcatccaatgtctgctgtgcggtatagccaaacattctgttagcttccctctgcagggtggtcagatcataaagcttcggagggcggaccgttttctctttcacatcatccttctccacttcgcacatgcgctcctgacactctgcagccactttatctgcatcttcttttttctgaaaatgctctgtgaccgcatccatatcgtcaaacttgatatgagccatataatatttttctttggtaaattccttgatcttctgatttcgatccacaatcatggcaagtgttggtgtctgtactcttccaactttcagattctggttatacagaacggaaaaaagacggctcgcattgattcccaccagccagtctgcctttgccctgcaaagtgctgactgatagagactgtcataacacgaaccgtcttttaatgacgaaaatccatctttaattgcctgttcttccatggaagagatccagagtcgcttcatcggcattttacatcctgcctgctcatacaccagacggaagatcagctcaccttcacgtcctgcatcagttgcacagatcacttcatctactttggaatctctcatcagtttctttaagattccgaactgcttctttgtgccctccaaaatcttgtgtttccaacattccggcacaatcggcagatcttcatatctccattttttatatttttcatcgtattccgatgcatcacataatccaaccagatgtcctacgcaccaggaaacgagataaccgtttccctccacgtagccatcttttcttgttctggctccaagcacggaagccagtgccatcgcaaccgatggcttttctgcaatcactaatttcatttactcctgctcctcttcttcatcttccagcacattatcgtcaaaatcttcatctctcaggatttccggttctgtactttcttcctgctcatctgcatcgtctacttcccgtttttctgactctgaatcttcggattcatcttcatcctcttccatctcatcctcgtcatcatattcatgctttggtttatagactttgaagtaatatcctcctgccgcagctccgactgcaaccagtgcaatcaaaagatacgttccaaatggacttttatcttcaggcatctgaatatcatcctctaccttatctttctcggctgactctgtcgtttccggcttttcttcctctgcttttttctctggttctgcataaaccgtatctacttccggaagtgtcaccgaatcagaaagtgtaaagttcatcagatctttttcactgacttctgtaagaaaatacacattatcctgagattttgaattgtcaataatcagatagaaaatcttaccactcttagttgaaatggtataaaactcttttgtgccttccgtagctgttttggtaacagaatctgctgtctcgccttctttattaagctgttcctcaatacctgttactgtccgatcatccacggttccttttgcatctgttggctcagaagcctgtgcatcctgtggaagtggtgaagtcgttgttttctcagtcccagttgtatctgcactggtcgtagttgccattgcgccattactgtcattggaggttttctgtttttctgcctgcttctttgcccattcataataaggattctgcaacacatacttttcagaagtatttccggcaccatccgttaccgtgatttcaatctgttttgttgtaaaatctttctgtgtcagttgcactctcagcattccatccttcaagtctgtataagtggtgccattgactgttactgcagtaatccctgatactgtatcattcccctgaatcgtcagcacaccatctgtcagggaagcagagagtgtaggcttttccgtgtcataacacttaatagagcgattctgctcatagaccttcccctcaccatctgtcacacgcacatacactgtctgatttccagtgatcgtgatacttccacttccggttacatcctgccagcttccatcttttcctgcttttgcttcaatctttgctattgagaaaccttccggcatatgactggcatctaccgtaacagcaatggttgtttctccctgtttccagccatccggtttctcaatcgtgattgcaggcgtggtattcttagctgcataagcagtctgtgtctggagcaaaggtgttgtcaggcaaagaaatgtcgttgctgcaagcaagctcttttttaccctgcttttagtaattgttctcttcttctgtttcattttttccagattcatcatcggcttttgtttcctccttctgtatttctaccctgccgggcagttcatttttcattctctttttgaaagcttccaattccggaatactcatatccattgcacggataattcttacaatttccagattttccgcttctgtttttgcaatctccgcagccttaaaccgctttaaatctgcttcatatctggctttggaagcttccattttctctttggctttctcataatctgccgtagctttttcaagacttttcatcggttctcctttccggacggctgatgcagccgcccttttttcttaccatcgtccaaatccatagaaatggctctgccagtatggggaattgatggacgtatactgcaccggatgtccacaatggatcatctgaccattgcctacatagattccgatatgcgttaccggctcccctgcgtcgtaagttccagtaaagaaaatcagatctcccggctgtgcctccgactgggatactggtgtacaaatgttgtacagtccctgtgctgttagtcttcctgtattccttacaccagagtttgtcagacagtagcttacaaatccagaacaatcgaatccacttggggaatatccaccccatacatatggtgttccaagatatctcgctgcttcatttaacaaacgctgtgctgcttcactggtatattcattgccgccaaagcctgctccttctccagtttccagataaaagatcgggtttaaccgctctccatttttcagaagttcaatatgaagatggcttcctgtggaattaccagtatttcctacaagacctatctcatcacctttcgtgacggatgctcctgcagatacactccggctgcttaaatgtgcataccgcagttcataaccttttctgtctttgataatgacgtaatttccatagctgtcgttataagcagaagttgtaactgttccggtcagtcctgccatcacttttgttccctccggtgctccgatatccataccattatgaagctgatttgctcctgatattggatgaatcctgtatccataatagctggtcacactggagtaccagttaaaatcaaccggtgttgcaaacatctgcaagttgccttttgtatcgttgtaggcactgaacagttctttctggaaaaatcccagcctgtcctgacagattgacatcaggtttccactatttaaggtgacattcagcacatctacatcccttgtcctagtcacttccacttcctgacttccattatcatctgccagataacattcccatgtctgatgtccatgtgcagatgccgccgcatgattatcatagtagacgtcaaactgtaccccgtatcttgcgaaagctccggtatcttctaccgtatattcgacaccattcattaccacctttgttcccattggaacaaacggattggaagcatctaccgctaaggtgtgattggctgttggatatgctccactggcagttggtcctccgctccaaataccacagcagattggacaattacaatatccgcttgttacaacctgtcccaaagattctccaactcttactgttgctgtctctgtcacagtctcattgaccgcttctgtagtcagatgatattgctctgcaaacaaagcatccagctccggcttgacctgttcaaacgtaaactcttcatactttgctgacagataactgatcaggataaacggatcatgctcaataggtccgatgttatatcggtattcctcatgtcccggttcttcagattccatgttgttgatccgctcctgcagattagcttccagctgtgtataatacagttccgcttcccggattgcctgatccgatgacagataactggttcctgtgtaagtgatcacattttgtaaaaacactgcagagcatgacgtgacattcgttatgatcagaaacatcaatccgatcagaactgctacactgatatacactttccggttttctttaaagaagttggtcactttgccgccaatcttcttgatataatcaatcgtaccttttgcagctgttcctactgtctgttcacttcgcttcgctttggcataatcccgtttgatctgttgcttctgaatctgctttttcagcttcttctgctcctgacgggctgccgcctgtgtctgtttctctacctgtctctccagtctgcttctctttctggaagccctctgtttccttcgtctggcacttctctgttccagccggtaaataccttcgccgccttcttccaacttatgggcaccttctaccgccgcattatcgtcttcatttttgctgatctcacggtgcaatgctacggaagttgcacttcctgctttcttgacaacagaagctttttctgttttcacagattccccttcaccaaacttcaaacgggattttttctttccaggagattctccttcatttgcctgatagacctgtgctttcttggaatgctgctttgcttcctttctctttcttgcttcttcataagaaaactttttggctttttctttctgtttctgatggcggaaattgactccatccgtatccatctggttcaatttctccatatctttgtcatttttcacagaagcaccagtttcctcataagcaaacttcaaacgttgtttttgtttaggctttttgctgccaccggtctgatttctccggctgtctcccctgttttctgatagatcagcacgtttatctttcagtctccctaactgtccgacttcggatttttctgcaagtctggattcttttccgacttcagcacggattctttttctattttgctgcttactactctgtccaaaatccccactttgcttctctgtccgtatcagttccggtgcatctctggatttttgcacagagggacgaatatttttcccactccgttcagactggcggggagacttatccacaaggttttcttctttttccccctgttttcttcccatctgcacatcactggcacggttactgacacgaacagaagatttatctgtcaggttttcttccaccagaccatccttggtcatcttttggactttcttgtccctgactttcattctctgttctgccactacttactcctccttcttcggataccctttccctgcctgtaataagcagagaaaagcgatgccgaaaacagcaccgccactaaaagttaatacatatgaaattgctcgtaacattgttttctcctttgatttaacctgcttcggaagtctcctctaagcgggttgtcatgattttatagagggaattcttcgggaatctgtctacaaatgggataatgacatttccatagaacaaaagtccttccccctcattactgttggttacataggacagctgggttggtgagatattcagctgctttgccagaatctgcctgtctccggaagcctggttcagcatataaataaaatctgaattttcaaatatattctctatctccctggaagacaataaatcttttatattctgggtgattccagttggaataccaccccatttacgaaatctcttccatatctccacactataagctgcggtctgctcttccttcaaaagaagatggaactcatccacatagtatctggtggacttatgagcagaacggttcattgttaccctgttccagacctgatcctgaatgacaagcatcccaatctttttcaactgcttaccaagttccttgatatcaaagcagacaatgcggttattgatgtccacgtttgtctgatggttaaacacattcaaagaacctgtaacatagatttccaacgaagtggccagtcgctgtgcttctggctcttcctgttttctcagaaggttatataaatcctccaagattggcatcttctccggtactggatcggcaagatattcctgatatactaaccgcacacaacggtcaatgatggtcttttctaccggctccagtccattctttcctccaacaatcagctcacacaaagacagaataaaatctgctttcaatgacagtggattatcttcctcggaatagttcaggttcagatccattggattgatatactggtcagatactggcgaaacccgaactacctgcccatgcagtgcctgcacaagtgccgaatattcggcttctggatcacagataatgatatcgtcttccgtgatcaaaaagcagtttgtaatttccctctttgctgagaaagacttaccggaacctggtgtaccaagaatcagtccattcgggttcttcaaacgtttccgatcaaccatgatcatgttgttggataatgcattcaatccataataaagagcttccccttcctgaaacagttcctgtgtcgtaaatggcacgaagatcgctgttgaagatgtggtaagccctctctgaatttcaatccgattgactcccagtggaatacaggacatgagtgctgcttcctgctgataatccagttgttttaaagaacagttatatttctgtgcaattccctgcacctggaaaatattgttatccagtttctgacgcttccttgcggtattcatcaccagaaccgttacaagaaacattcgttcatttctggactgcagatcttccaacaggttcttcgcctcttctccataagtcacaaggtccgatggaagcacgtccatatcataaccggaacgtactgcccgcttctgctcttcaatcttcatcttatccagatctgaaatcttgctcttgatcatcttgatcgcagaactctggtcaatggactggatatgaatgttaacattgatgctgtcatccacatccaagaaatctgcaagcatccggtctgtaagctccggtgccagaatctgcagataactcacacttcccatcgttcttcccatcaaaaatgtctgattcttggaaaagttaaaggaagtcggtgcaataaaatctttggtctttaatcctgtttctggaagcatcttatactggaacttaaatggttcaatccgatcctggttgaacacatgatacagaatctccagcctttccagaccattcagggaatgcgcctgtgctcccaaaaccttaaagttatttaagatatctgtttcgattctttcaagccttggtcttgccaccttcaggttttctgcttcgattccaaaagtgatatactttgtctttaccagaccattatttcctttggaaagctgatttttcagcatagtacggtactcttcacgaatggcattgaagtcatcgttctgatccggaatatcaatacttttttcaaattctgccacatccacctgctgattgataaaggacagctgcacactgatggaagaatcaaagtaatttaagaaatcacagtaattttcaaatatcgtggtcttatcctcatttagagcaagctgatagttgatgtcataaaactgaatcgtcttggagaaaaaggtctttgtcacctggcagataccatcctgcagcatccgaatatacggaatactctgctgtgcagttgtaggaatgtttttctgtttcctacgatcccgttcctgcttctttctacgcttttcctgttctctttcttttctgctttttttgtttcttctttcctgacggtttcttttttccgccagggacagacgctcctgctgagcctcctgctttgtcttttttgccatccggcacaccctcctttttcacaagggtggaaatctcctgataaaaattttctgtcttatatggtcttactgccggacagataaacttctgtcgaatgatatttgccaccactttttcaaagggaagaccgtctttttcatacattgccatgaagaaaaacggaagcatgatcgttaccatcaggatggctgcgatactggaaccgattggttttctcatgaccagataaaacggaattcccacaactgcggcaagtgaaaagaaaatcagctgccgctttgtcagatttaacgctacttttgttttgaccttggtaaggtcttttggtactggtacatacgccatggtatgcgctcctttcctgcccgttagtgggcattaaatattgatttgctaaggcttccggtcttgaataatgaaaatgcaagaatcacggtataagccgctactgaaaacattgctgcatgaaggtcactggatatggtcattgcatttactaaaactgcataaattcccacacagaccatcatgaagaatccctgaaatgccagtgcgaacaagccttttaaatagttgtttccgatattgccccattccttattggtcatggtggcaaacggaattggtgctatggaagtataaaggtaaatttctatcattcttccgtacaagattaccgtaatgataattgacagaatgtgcatggtaacactgatcaacattgtttccatggatagcaggaacaaatcccctaactccatatcctccagggcatccacaatccgtgtaattgcttctgttgcatccaccgcagtgtttcctgatatcaccccggcggcattgttgaccacatgctggccaacatcaaagaccgccatcgtgatattgaacgtatttgtcaccagataaatggctacatacgctttgaagatccagaggaaaatgttataagtctcaaattcatggaaattgtttttctgtgttaccatcgtgatcaattcatagcacaggacaaaggtgatgatcagtcccgcaatggggacaatcaccgtttgggatatattctgaatcagattaaaaatccctgcattccatccctgcggtgtctgtcccacctgcccggctatggttcccacctgctcattgacagacgtgaacatgttatccaaacttgacttgataagcccgatcaggatatcctttatcgcttccgtaattctctcaatgatggtgttcatctaccactcctcttaagagaacaatgttgccagctgtggaatcagggtagttcccagcagcatgattccggcaccggccatcagctgtttgatgccctggctcttagcaccgggattgtcatttccatatccttccagaaggtttacgacaccccacacgccaagacctgcgccgattgcgactacaagagtttttaaagttgtaattgcactgctaaaaaatgccatatacattcaccaaaactgacttttttcaggtgtttacgggaatgaaaaaaacaccgactaaaaagccggcgcacctaatgtcagttattcctttcctcattatttttcgttcattcccatggttactccgacagctccacctgaattacctccacctcttcttcgggtttcggtgtgtactgcggatttaactctttttctactttgtatcggtttttctcattttcatctgcaagaaaccgataatttttgtgtttcgtgatatcatatttgtctgagaaaaatggtctggcaccacgaatctgcaggatacattttcctccatccatgactgcaatctcatcttctgtcatcagctgtttgcctgttttctggtaattcaatccaaaggacttctgattgctcctcgtttccgaagtgttatacagatcaatggtttccttacccagaagttcgctcatttcctttaaggtagttttctcttttccaccaagaaatagtgtagtatcacagttacccagaatggtatctgcactatccttatacattgcctttagctgactctgtgactgcaaaataatagaagcagagatttccctgcttcggatggttgcgattagcttgtcaaactgaggaatctgtccgatgttggcaaactcatcagcgatgacacgcacatgcaccggaagtcttccaccatatacatcatctgccttatcacaaagcaaattgaaaagctgtgactgcagcatcgcaatcacaaagttgaaggttgtatctgtatcagacataatcagaaacaaggctgttttcctgtcaccgatcttatccagttccatttcatcataagacatgatcccacgaagctctgcgatgtcaaatggggcaagtctggctccacaggaaatcaaaatcgattttgcagttttgccagtaacaaaatgtcaatagttttttaatcacttttttcaaaaaggcaaaaaaaatagaacgtatagattatttccatacgctctatctcacatttcatattaaatttttgaattctacaaactggaagttaactatttatcaattcttgcagttcattgacaaaccggcagatatgaaatccatcacacactgcatgatgcacttggatggcaagaggaagtatgattttttcatcatctctgtaatatttccccatcgtaaaaataggaatcaaataatcatatcctttctgcaaattcagattaaagccatcgaaggttgaccatggtatcatcgatacattaaaaacattttcgggtacatctggttttcctatcattccataattgcttccataccgttgcatatcattcgcatacgccatagaaaatgcttcaaaatctggtatgtatggtgtccaaaggttggaaaatgtctctgtgtcctcatggaatatggtatagctgggtatcatctcgtcatatattcccagttcaccctcctgattaattgccgttctaaactctgaatgacggtttacaatcgttgcaagataatacagcatcgcagggtataatttcattcgtttcttttttatttgtgtaatatccaatttaacagtcatactgtatgtgcaaggtatattcgtaaagtaattttcaaaatactcgttccgtttccaactacttctatcaattttttcgaataccatctaagttccctcccaaattctgattattgtccttttacaaaggctgcatcatctcaagaatgattccatccgggtctctgaaataaaacgctctgctttccccaaatccatctgccctgaaatcaaaatgctgcggttcagacaaacactccacatgattttcgataagggttttgtagacagaatcaatgtcatccgtgtaaaagcatacttctgagatagatgtcgtaaacaagtctgattgctctttatggattttgctatctacaaactgaatcagctcaactggcggtgcctcaatagccttggagccattcaaataagcaactcttgctttgcaatttgctctacgaaacattttatctgtttcttcgccttccataaaaatttctccttgaaattcaagtccaaggatgtctctgtagaaagcaatcgagcgatccaagtcagaaaccgttaatccaacgtgataaattcttccaaccatatatattcctcctacaatttctttatttcgtaaaacttgaagttatagtgctatctttttccattttctaatcttagttctaaatgttccgaacggagcaaccgtgttaatatgtataaacttgtatacttcccagaccgctgttttggttgcttcatcggcccactttctcatatgtggctcgaataactcttcgtcgcttaatgagtcaatcatttcataaatcgaattaatattctctttcagcatatctttcaactcctgcaacgacagatgcgcatatgtatctgtgaaccattggtataattcgccaagctgattccacttaaaatcatccgaaggagtcttgacatgaagaccctttctttcgtctgattcccatttaagaacaagagttgtccagccaacctggtaagcaagattttctgctggagttctgtcaactccctcaactctcttatcttttaatgattccggaataatatcaaattcagaaatgtattttgcaaaacttttatttatctcgttcttaagttcatctttattctcgtatgttctcaatataattctccttaattctctaccttttatttcaacagtgaatataatatttttcagtttcaaaaatcggaatttatgaactcaagttcgttaccagtgacgaatatctttttgtcttatttttaatatcttcctcagtaacaccataataactatataaatctctggatattttcttaaattttttcattaccgccttatttcctgaataagacattccaaatatattccaagtgtaatctatctccatttcaagaaaatcatcatcgattcttattttatataaatgaaaatccataggaattatactatcgggcatttcagcaatcatttcacttcgagtctttattttacccaaatactctttggcggatgcttcattagaaaaatccggtaccggaatatccttcatttcacccaaaagttctggttcatactgcaaaatcaaactctcttttagacattttatttgttcaatatattctctatcagtgggagcagtttctgtcaattcgtatttatcttttgcatactgcactgtttcagaaagagaatgcgaatttgcaactattgtcttctctactttttttctcttatatctatatatgctatttttgattctaatctttaatggttgcttttttgaatgtcctgctataaaaatgcttgtaggaccatctgcaccacctatgattgaaatcgcatttttacttttttgctccattcgccttttcattcaccttttcctcacaaattccgatttgttgctcaaatcatatcacattctcaaacatatctcaattccaattgtctctgcccccatctattgcattgcctttcggcttgcttctgtaaccagcatccggttaatcttttcttgcatggtttcctttgcatcttcattgaaatgatagcggacaacatatactgtctgcccgattttctttgtaaatgtgtttccttctgtttttttattcatcattttttccataatcatctatttcctttctttcctgtgcccgacagagagaggtttgcttctgtccctgccgggagtttatcggcacgctgacaacgcaagtgtcaacatggggtttgaaacttttttcgggtagttatttctgttttccaaaatactattgaaaagttttttgaatgttcttgttgacacctgttaaaaagtagctgaaacaccggtaaatacaaaggattttggtgtcaacaaaaatgtcaacaagcagtaaatttccgggtaatcagtagcctttcggcatcaaaatcagcctttctctctgtcgggcagatcaaatggcagctccaactgttctgctttcgtcagctttgtaaatccatctttatccggttcgttgccaccctcttcttctgctccttccctgatccagcttctctgtctgccatatccttcctttgaaaatctgtggactccggctctcttccagccagtgatctgcgtatccataatggaacagatctcatttgtctcgaattttttcggctcccggtcaaaatggtcaaaggcttctttccagatctggacggaacatacatgactacctttataagcgtccagccagccttgtatcattcctgccatcgtatcttcctgtgtgaactgttttcggtattcactgatctcctgctccatttcctttgagaacttcaacaggctgctcttattctccgttgaccagtagatttccattacttctgcccacaactggtcaaaataggatctggcttctttttcatcatcgaggatatgcttctctgccttactgctgtctatggcaatcggcaggaaccgtcttgccccagtacggtcaaaaggaatgaactgccttgtgttcgttgaacctgcaaagatacactgacgcttccggtcttcctcatatttatcataagggttccggtaagtgtctttctgtctggtcaggaatgacttgatttcctcattgctctttgcactgattgcagcaatcatctccgacatttccataatccagtgtccccggagatgctcgtatatcttactgtcattcaactgcttcagatcatcagaaaaccagtcatcgttcaatgcaagaaaacggaaaaatgtggattttccggctccctgctgacctaccagacaaagcatttcatctgctttacaaccgggacggtagattctgcttaatgcttccatcaggaagtgcttcacaacctcatagacaaaatccgaagcatctgcccccatgtaccgttgcaggacataacggattctctcctgcccgtcccactccagttgttccagatactcacagatcgggtggtatgcccggctgttggcttctatacggagtgccttatccatacatttttcacttgtgagtttgtaatagcattcaaagaaatagtagaaataagtcctgccatcatcatccagcttgcagacttcctcattccaccagagtttttttacaatatcaatcctgcctgtcagcttattgtatttcatactctcacgcacaagcggatcatttctcagcacaaccatataatttccaaccgttgctttcgcagttcctttctgtgtatattccagcatctgtttcacttcatcgactttgcttttatctaccatctggagcatttctttcattgcatctttctgttcttttgtagcgatctcctttatcttctctttcgcattgctcaatccgctccacctccttccatttttcttttacaagtgcttccttatctgccctgtccccaaagagcaggatatccagataatactcaacaactgacaactccctgagagcagtcataaacttttcatgccattcttctgtccgtgtttttggtgcatactgttctttccattccagaagcaggctcagataatccagataggctctcaggcatctcagatgttttttctgccaaagttcttctggtgtcggctcttgcttttttgctgaaacgcttctcctgttctgcggtgatcccctgtccctgccggaataaggaatcccaaaatcatctgccagcttcatggctgcatctttcaatccaatgtcaaacagttgtgccgtaaaatcaatggcatctcctgtacagccacacccgaaacaataatatctccggtcaactttcatgctgggtgatttgtcattatggaaaatgcagcggatcagtccgctcctgttgggctttaacccatacctctccgcagcctgccggacggtcacattctgttttacttcatcaaataatcccaattcgtttcctctctttcttaaatctgcttcccaaatctgggaagcaagttttcacaaaaaacaaaaaagcactttgtcctgtccttacggaatcaacaaaatgcccttatagttccagatcactggaatgtgatcttcctttattcagttgttttctctctgcctcttctctttgaatctttgctacgttcaatgcaagtttttctctgattgacggcttcacttcttttttgatttcttctacaacggcttttttcttctctggctgttttaactgacggacaaccctcacaacagctttttccatcgcatattcgatttttttaatcagaccgtccagcctgtttatcgcatattccttttcttttcgtgatgccttacgttccggactctgaatccatctcttagaatcttccgcaagacgaatgtcatcttttctggtagcccgcattgtttcctctgcgactttatccacagccttgtcataggcttcactggatacttcgtcaagcaaggtttccacatcttcaatacggagggtaagctgttgcagttcctctctctgttcttcaatcagctcgccctgacttagaatccggtcagaattggaaatgaaattttctttaaattctttttcctgctgttctattttttctttctgtgactggataaccttttcatttgccctgacatggtttgactgccttgcaagttccagatgattcgcattgaccttatccctctgctgattgagcatttcctgctgaaccgcaatctcttctttctgcttcattcggatatagtcctgtttctccagatactgccttcctccataggacggttcttcgtcaatttccagtccatgacgtttacagatatccaggaacattgtccggcaggcagaatcaaaaacaaccttacggttatttgtctttgatcttttcttttccggattcggaagttcaaagccaagttcttccagtgccgcttcctgtttcggttcaatctccccataccggttcgtagcatcgaatacatgacgctcatgaatatgcggagtcgcttcgtccatgtgcagtgaccagtcaatgatatgcacattagaaccaaaccgctcatcgaactctttcttgaattcatcaaaaaccaaaaccagcgtttccacagaagcgtgttcatctatcgtcccaagctgatagatactttcttccggacaggtctttttatttttcagaacatcttccacccctttacatctgtcggggtgtcttgctttctcatgacgtttattctggttaatcacataatcgctgtaatgatccacatagtatgccatctcaatctggttaaaagaaaaattatcctcttttccccggtctgccattgtggtatatccctgatagcagtcccagtaaatattctgacggacacgttcattgtcaatatgctcactgtgttccgggtcaaatctccggtcattgtgaagcggattgtaaacaccgtctttcccagatctgccgttatgccttgtgcctttcaattcacatctctccttttttcaagttgtttccccggaggggattgcagcgaagcttccaaaagtctctgtccccgttacagacagtacccagtaccatatggcgaaacgccatatcactgggcaatggctgccgcccttaacctgctaagggctttgccccttaaccccagcaagatgctgccgctctttgcaatctgggcacaaaggacttccagccctctgtactcccagcagacaaaacgtaactcctgccgctgtcccttcagcaggatctccgttccgtctgtttttcaaaaatcctctgcatcggattttgtgaaaatataaaaatgggtaaaacaaagggcactaactttttacggttaatgccctttcctttactcattcacttttcagataattcctgtatgtatcattctgataattgcttcagaaccattttaacattcttcctaagtttcattccgtccctcagtcccaaccggtagaaaaattcttctgtctctgctccactgttaaatatctggtcgcaatattttgtaatggcctcttcctgtttctgtggaagtgtggcaatcacttttttatattcttcctcaacttcatctggttctgtcacagacggctggctcagtttccagtctgcatactcttttcccatatgctccgttatggtcaggttgataaattcttcaatctcttttgtaatcttcatttaagaatcctattcctttctccagtggtctacttcatcaatctgattttgattgtttccagccacaccactgcccagccagaaagcacagcaggatataaagtataaaacctgccacaagcatcctgaccgcttctgtgcctgtctcctgtccgaatccataccctaaaactgctgtaatgcagatgatccccgacaggatatgaaataccgttgccgacagccatgtgaagaacataaccaccagttgtatcattgtcaggcatatacgcactggcagtaatacgattttcacaataattcttacaacaaccatgactgtccacccctttcactgtttcagataactacgatagctgtctatcacagaatctgtcacaccgcttttgtaaatctttcggatatcaacgattttttcatctttcaaaagtttcagccagtccagtaaatcttttctgctgtttgcaaaattacaacatcttccgtctgcatattcaatccagtatctcataagtccctcctacacatacaccagttcatttaaaataatttcatctacccggcttcttgcattgtttgcccggcgaacccattccatctgatctctgcttttcaattcttccgtaatgccttcctgctccataatctgttccatgaggaaatccctgcgttccaaacactgctcattcagatctgcgagatacgtccagagcttaccactcaatgtcagataggaatacaagccactcttgtaatctttcagatagtttctgtgaagacttccataaaaaccaatctctcttttctcttcgggtactgcgatcagtggcagatagatttccccgacaaggatataatccagaccattactgttatcgtgaatgattctttctaatttgctcatgctgatgcaactcctttcttcggttctgctgggggaagcagtgatagcggaatgaacacaccttttgcaatatcttcctgccggatctcttctttttttgcatccagttcggctttcttttttgcctttgtccgttcatagtattcctgctgctttccatttgcttttcttctcagataattctggtgaagcctgtcttttctggcttcccgtttttccatttcttcaatttcttccggtgtcattttcacctcaccgaaatgtggcggtaaatatctgccgatgaagttaaaatagatttccacttcctgtgtcgtctcaacgcttcctttccggtcacgctcatgcaccacaatcttttctacaaattcattcagcatgtaagtggtcaattcctcaaaattttggtatttatcaaccagagcaataaacttctccgctgatctgcgaccttcttcatagcctgataattcagcttccatatctgcaatttctgccgacaaatctttctgttctttagaatactgtccatcaagaatcgcatagcgttcatctggcagcttgccaagaatattgtcctcataaattctgcagatcagtttttccagttcctgcacacgcttttttgcctctgccaatctgcttttcaatcttgtgatctcactggactgctgtgaagtctgtgccttttttactgtctccaaaaattcttcacgattcaactgtgaatactccgcaacagcctttaaaagttccttaatcagctccataaccacatcagcattaattctgtgctgtgtctggcagagtgttccaaccggaactttagaatatgcagaacaagtatattgtggtacttgcttgccattatttactcgatggacatacattttggaaccacagtctgcacaatacatcagacctgtcaaggggtgggcttctccccatccatctgggtaccttctcacattgcttcggattctctgcacattgtcaaaagtttcctgatctatgattgcttcctgcgtgttctcaaacaccgtccagttatcctcagatacataatggcttttcttatccttgaaatgttttctggtcttgaagttcactgtatgaccaagatactctcttttcttcagaatacctgcaacagtagaagagccccagccataaggatctttgatttcttctactctgcctttccataatccggcatctttctttgccatatgaaccgctggtatctcaaccttatcctctttcagtgccttggcaatctgatatggtccgtacccgtccattgtcatgtgaaagattctccgtacaactacagctgcttcttcatcaacaatccatacattcggatcatccttgtctttcagatatccatacggtgttgtacttgccacatgcttgccggattttcctttcgccttgaaagttgattttatctttttactggtatcccttgcataccattcattcatgatatttcggaatggagtaaaatcatcgtcctcccggaagctgtctacattctcgttgactgcaatcaggcggacattcttctgtcgcagcaattccatatattgtccgactttcagataatctcttcccattcggctcatatctttaatcagaatcgttccgactttccccgactctacttctttcatcatggcaagaaagcctgggcgatcaaatcttgtaccggagataccatcatcagtaaaatgaacaagattggtaaatccatgttcttttgcatattgttccagcagtttcttctggtttgaaatactgttggattccccgtttaattcatcatcacgactaagacgttcatacaacgctgtcatgaatccctgtttctctgtcatagtcagatgtcctccttcctttgtttattaattgcctgttctcatcccatatccgttcctgtaccgggttctgatgtttccgggacgtattaaccagaaaagacacgctgaatgcctattcagttctggtatcactacgggcagactgtttcgttttcaaggttcgtgtaagaagtaaaaaagattcttacactaaacgaaatgctcagaggtctttttacagcccccttactgcatcttttttgatttcgtgtcatctttttaaagttccttacacaatctctgtactgacgaaacaaaatacggacatgttttgaaattgttttttacaaaatacaattttgttctttaaggtaaaaaaataagcctcaagagactttttaatcattttggagctccaactctttaaatttgattgattaagaagtctcttcaaacttactacaccggcggccattttgtattttttatactgtctgaccgcaaagtgctgcggatctctttcttccagttcctggaacatcatatccactggattctggtaagtttcatcctcttcacgggtttcgctttcattcaaaagatccaaaagggtattcagatttttttcctcttcatcaccttcataccagataaaagcaatcagtgctgtgtagagcaatttctctgctttcacccaaaaatcttcggaagctttttccccttcacctttggtattaacaatgattgtcgttaccagcttcaggatatccttttcagaccgtatataagcaaatggattgtaatgaagggacttggaaaaattgatggtattcagaaccttaatcacatatggctcatgtaccacttttccagatttatctttcataatatttccattcttatctttcttaggtggtccctttgctaacatcttcccgcactcttcaatcaaagtgcctttcggatctgtaatgaccatggaacagttcatctgcatgaccgatggttttacgaaaaaacgtgtcttaccggaaccactgccgccgatgaccactatatttttatttctcgcatacttcggctgcttcggtctgctctccatggtcagtgcttctgttgctgtcaatggaatgttcatccatggatcttccgacatataaggtttgatatcctcagcgtttccccatctggctgaaccatactcgattccttttcggagtttctttgcatctgactgtttctgccaaaccagcactttcaaaacgactgcaaccgtaatccctgccagcagatctttccagttattgcttaacacaaaaccagcaaaaatccgatctgcgtgttccatagcatataagagtttgttccccatatcttctcccggactattccggtaaagaaaaaatgcccggtctgcatagaacgcagccagagcatatgggagattggtaagaaccagtttctttttatccagggcggacagcctgaccccgatcttattcttccacttctgcatcagaggtttgccgatctgtttcttcatcgactctgctcctgatgccggttctttactttgtccttcgtcttctttggcatcattgcccggtaagctgccagacgcttgtgaatcgaaggtttattcgctttttgaatctgtttctgggaaaactcacggaaagcagcattgagggcatcctgatcacgtcctttgaaaaataccagataaactggcggctctttgctcttgtcctttttcagagcatagttaattccatattttctggcatagcgttcaaaggacttgatatttttgttcgtgatctcgatattgaccatcccggcattctgctttgccagctcttttaccgtgacctttccctgtttcggctgatttttctgtgctttcttctctaccgatttctgcttatgatgccgcagatacgcagcaagaacctttctcaacaggtctgctgtgattttggtagtccgaatacagaacgtgaccgttttctgagttacctcttcctgcatgacttttccctcctttcagcgatttaactgctgtccagatctgtaatcatggcaatcaccccctttcaataaaaaaggacagattaaccggtaatcaggctctgtacctgtacgagtttttctgtcccttcttcttttctcttatcttctccaccacaatagatgggaacacacatttcaagtattctgctataaatacgctgatgggcagtatctaaatctgtggatttcatttcattcagtcccagattcgttgttacgatcagcggaagcattttacaataacggctgtctatcacattatagacctgctccaaagcaaactcggaatttcgttctattcctaaatcatcaataatcagcagcggataatccacaagattttgtataatctggttcttatctgcctgatagctagtaatttcgtttaagatcctggaaaaattcgtcatcataacacgttctccctgttccaaaagtgcatttgcaatacagcctgcaaagaaacttttcccggttccaactggtcccatcaaaagcaatcctacattttttctcttcatatttgtccagttttctacatactgcctggcaattagtgtcttctggttgcttccattgtcattttcaaatttccattcccagaatcttctttcccgaagtccgacggattttctctgataaagctgccgctgtgcttcttcccgctgcatcttctcatcaagttcctgcctggcttttacctcgcattcacacaaacaggacactacatgctcaaatcccatcagactaactttcatctgttttctttttccacagataccacaatgaagacatccctcttcatccagataatctgctgttactttattttccatcacaggctttctccttcctgaaattcatatttatccattcctgccctggctccatctcgttctgcccaaagacagattgttgcaaaatgattctgatactcttttccactggatttcatataaacagaaagatgatcaatccgtttctgataatcccatggaaataacgtcatcaactcctgcagttcagcttccgacagaacaacatttttaaatctcccatacagaccgaatttttcttccaaagcgggagtattgcccttactcttatcagtatgattcttttcagtcttatttatcttagtattacttccatccagattcttgcagtccggacttctatttttttgcgttccggacttccagtttcttgcaatccggatttccaattccttgcagtccggatttccagtttctggcgttccagaagcaaagtatcttacgggctttcctctaatccgtttcacaaaatttttcacgtatatgacagagggacgattattcccctgccgataccgttcaatcaatccaatcccatgcacactgtcaagctcataaagaagctttgtcactgtcgtatgcgacattcgcaatagttcctgcaattctgcgatcgtgtaaatgatatagacataaccatcactatcaatccatccatttttcttggataggctgattcgatcaagcagaattccgtaaaggagctttgcgtctgtagacaggcttgcaaactctttttctgtgaacagagcttttggtatccgaaaaaaagaaaactggtcagattcttctgctctgaaatattcaaaatctgccataatattttcctactcttctacatcgaaatcacaatttgctgcactgcctgtaccatgacacatctcatcaaacacaaaattaaatgactgaatcatttcatccaaataataatttctagccttcttgttgcaagcatacatatcaccaataaagccttcatcattccccatcgcatgaacgagggtttccaggaccttcataaacttcttttttgaacagctttcatactgtctgttcacatatttctgaatatctaacacacgagcaggattattttcattttcctccagaattccaaacgcaagatccatgccaaactcatatccatcagcctgaatttgatcaatatccatctcgccaagctcatcctgatatcctctctcttccattgcagttaaagacgtttcgtattcatcaatatatcccatatctgcaattgtttccaaaatatccctggatgctttcaccatcttatccataataatttctctttcaactaacggcatatttgccataatagtatctaatgtcatcattgatttttcctccttctcattttcataaatatcgctgatataaaagtggttcgcttttccattgtttggaataattcgcatcagctttccagccttaaccagttcctgtactgcctgatctactccatatctggtcgtattcaagtcttttttcatttcacttttcggatagattacaaacaaatccccattatgatctacccagccattctgcactgcaaacttcaaacgatccagaaataagctatataaaatctttgctgtatttgacagatttttgtatttttctatctggaacagcacctttggcacctgcagacaatctaccggcatatactccatcttactcattaattgtttcctccttctgtttgtacagcacttcggctgaagtaatattgatttccagcatacccacaaatacctgatagtacagcaggcatatctgttcatcctcccttgccagatacaatccttccagttcattggacggatgtttcattccatatactgcctgacagatatcatggattttctcacattccacacttctcagatgcatctccaaagtatggttaaatctctgccagtcctccaatttctgatttactgacatcatgcactggaacagttccgctgcttcacatgctgctgacagcactacatttttgttattgatacttccatcggcatttttcatatgccctaccatatacgcctgatctactgaaaccatcttttatcctcctctatctaaacggcatttcctcttccatgccctccggtatctctaaaaacccttccgcatcttctggaaatggtggtctgtcaaccatttttgcacctgcaaattcaatccggtttgcatacacttcggtggtatagatctttttcccggtatctttatcttcataattacccgtgacaatctcgccttccaccatgaccttcgttccctgcatcagataatctctggcaaattctgctttctttgcaaaagcctttaccggaatgaaactgacttcatcagaataatttcttctgactgccagaacaaacttggcaatcttatgaagtcctttttcattctccacttcgttgtatccgggatttcttaccaatcgcccggaaataattgttgtattcattggcttaaccctcctatgctttcattgatttgtaacagataccgatacatggtccacattttccataggcacatccgtaacattcatctttttccaactcttcctgcttcatttcatcgtcaaacattcctaacagcgttgtgtaaatctttttcattgctaggaatttttcttctgctttttccatcttctctttgtaaaatgggatcagtttacgaagaattggatggaaacgttcattttcatcatcccaggcacaggttttcatcatacagcgtggctgtttctcataattgcccagataatacgggcagaacgtacagcctctttctttaacaatttccaccgggattactggcatctgacttttgatttcctttgttacatgcttactttcaattcgctctctcatcttaaaaatcctccaaaaatatatatttgcaaaagggatttcccctgaattgcctgatttttggtacaaaaaaagaggcaagcttacgattttattttcgcaagcctgcctcttatcaaatattcaattattttccgatgatatatcgtaagaaaacgtataccgcacggattacatacactggaatcatgatacttccaatcaaagctccaatgatgacacttaatgcagccatcccaagtgttgctgttatatccattccttttggaatcaggatcagccgcattttatgtattccaaatggaagtccggaaagaaatatccaccagaacaagtctgtctgtccactgactttcatgatggtggataccatccagaaccagaatagcataaatgccagtggcaatattgattttttaattacgtcttcaatcgtcaccttttttctccctctctctgattccttccgccacctcccgattaagatttgccaatatttttctaaccacaggagaatccaatcgaaaggtttccatatctttctcagtaagctcccttccgttcgcatcatatcttcgtacaatctttaaagccatactttcacttccttcctgttgataatcctaatgttttcaacaaatgtttaaacttctctcttttcatccgtttaacacgtatcttttctatcttcttcagataaacttgtattctacttgccgtatcttcattgctcattctttcccctctctttctgcccacgatgccagaagcataaatataatttcttccatctgatcctttgtatatgtctctggaaaatattgtttcaatttcttcgccggaatctgcacctgaactttttcagtactttcattcatgcaaatctggtcaatctctgaatacgtcaacatctgctcttttgaaatctgcttcaattcctttgcctgcttcatggacggtaccatattgtgattactcatatactgaaataatatctgctgctcttcagttctcaaataagaaagttcaacagctgtgttaaagggaagcttcttctcgtctgccaattctaatagctctgctactaactctgtcagatgaatatatcgaagaatctgtctggaactatctcctgtattctgactgacttcttctgccgccaacttcttgccaacttggcaagaagttaaatcagatcgttttccctgacgctttaacgcctcatatttcattttataagcaaatgccttttcgctgatcagcagctcttctcgttgaatgttggaatctaccataatcaccgtcgcttcatcatctgtaagatctttgatgataaccggcattttctctagtccagaaagttcacatgctcgttttcgccgatgaccagctaccagctcataaccaccggactctctcaaccgcacaataccaggaaccaacacgccatattgtgtaatactttccgctaattcttccattttcttatcatctcttacttgaaacgggtgattcgtaaatggatgaagacttcctattgctatctcactaattccattggttgtctcttcgtttgttccaaacaatgcatcaagcggctgtaaggaaacgggagttgctctttttttagatggcatctttcagcacctcctccgtcactctccgataagcttctgtagctttgcctttcggatcataagagaaaatactctgtccttctctgactgcttccttcattcttacagaaaatggaatataattatcgaagatatgaatttgacttccatatacatttctgagaagttccatattattcctggcatcattcgtatgagcatcgaccatcgtaaacagaattccaccgacttgcagcttcggattgatttgcttacggaccttaccgattgtttttaataactgctgcaatcctttgattggcaggtaagacgcttcaaccggaattagtacttcatctgatgcagccagtgcattgattgtgatcattcccaatgatggcatacaatcaatgataattgcatcatattgatccttgataccatataaaatctgtttcaatacatattccctgctcattgcatttaccaactgtacttccgtacctgccagtccaatgttagaacagataatgtctattccttctgcctgatgcctgatataacagtctgaaggaatatcttcatctttcattactgtatccataagagctgtaagtgtttcattactttcatcacaatcacgatatccaaatcctgcagatacatcagactgtggatcggcatcaacgattaacactttcatattcttttgtgctaatcctactgctaaattagctgtacatgcggactttccagttccccctttttggtttacaatagaaataattctagccatttttcatcacctttcatcgtcgtcaatcaaaaagaggactgaattagacaaccggaatctatattccgtgcgagctaattcagtcctataattacaataattctgttgtttttactcttgtcttacacaaatccatttccagtctggatctgtaataattcatattctggaatgacagcgctgtcttatttttccctttttcagggagttaaaaataaggactaaattagtgcaaccccttgtatttactggagttttctaacttgtccttattataactcgaccatgagcggataccgttggtaacaattcagcatttctatgttcagtctttgcaatttgaacttcttttttgttatatgcgtctacaatattatataagatattgtttattgcactaggcatgagcggtctgccggactttgccatgaaaatgaatcctttataaccgtctatctcaacatcttttcctttttgaagcataaagtttaatttcttttgttcttcaaatgctctttgtacatctgatgtcatagggatagttcggattccagaatccgtctttggcgtggaaatatggaatttatagccatctcctaaatctttataaatcaactgatggtcaatacttaccgcttttgttctgacatctacatcttcccaagtcaatccaatcagttctccgcaccttacaccagttcctaacatgattctgagcattggatagtaggtgttgtatacttgattatttttcacaaattccagcattttttcctgttgtaaaactgttaaggcaatacgttcttctgcctgtctaccataatcactgatagaaaactttgccggattcttgcggataatatcatcatcaacagccatttccagtgccggacaaatcatattgtcaataaattttattgtagaatatgcatatcctgctttagaaagttttgagtaaaatgatttgatgtgtgatggtaaaatctgaacaaccctgatgtttccaatttcatctttgacacgattctcccatgttttcagataatttgctctagtagattctttcagctccctagtagacatatatctttcaaacaatttattaagagtaagttttttgattgctccatcagttaaaatgttatcttccaagtcttttgcaatctgcttttccttttcccttaattccggtaaatcctttgcatatactgtcagacgttttccgcttcttatatctgtataacggtaactgtatctaccatctttacgccagctttcgccctctcttaattttcttcctttatggtcttttctgctatttgccatgagaaacattcctttctgtaatagactcctttttgttctcatgacgtggttatgtctgtaaatattataccatatatcacaagaaacataaatgaaaaagggtgctattcttccagatatgagaggtaatttttgactttttctaccgaataaagaaccctgcgtccaattataatttttgctcctgcctgttctccaatctttcttgcagtagcatgaccacaagataacattgcagacaatttatctatatttaccgttatcggctgtgagattggtctttcttttgttttgttcatctgtcagccctccttttaccgacctgtattatcgtcattttctacacaccagtaaaagtatcattctcctttaccatgtgctttttacaagcaatcagacggcttcggcaagctccgctggtatctcaaccattcccattcctgtgggctgaaccgtgtcatacgggtgtatcattatcctgtgttgcaggtcatggcagagcgacttttccaacggtcgctcccagatcattgcatgaatcgctatctcccgattggaaaagtcacggcgtacaacctctgatggctcactgcaagcacaaacgtatctgactgctttattacttgtcaaagaactgttaggctcttgtcagcctgtatcaattcatttttgcaaatggactgatacagaatgataagaaaaagcggaacaggaaagaggggagtttgttaaatcatgctccgctcaaatattacttaatgttcgtctatttcaaattcacatatcattttcaaaagggcttctctgatacgtccctttaattccatatcaaccacaatgtatacgttaccgtattcatcataaaatgggcgtaaacaacattttgatatgtaggcttcatagaacagcaacagcttttctatggcgttttcgttaccgtctacggctgatgatatgagaaaaaatgatggaagtgtgtgttgcttattcttcatttgttttcttctcctttaactgctttctgatttcttcaagtgaatttcttctgtgcctgtatgatgtgcttcggttaatgttcagcttttcgcctatctccgaatcactcatatccaagaagaaaaacatcaatacaatgttccggctctgctccggcaactgtttcagtgcttctgcaagttcttcgtcaagtacacggatttctgtaccgcacacatcgaatgttgtatattcactttcgtaatcgtcccatacaatcaatttctcaacaacaatctctggaagctcacaaaaggatacttcctttgcctgtcgtctggctaattccttgcggtagttacgggcaatgcctttcacaacctttttgagcttacagtcaaactgacactgtattgtcttttggaagtctgatggtttcaaaatcacaccccctttctctataaagtgaaaagtatgtatccctctttccgcaccatatctgtacggcagggtgtgatttgttgcaggattgaaaaaattttttgtaaatatgaaaacagcctatttgcaccaataacaaatagactgtttttaaaacatctgatatatgagtttttaattcatgttcaaggactgatgatgtactgagaaaaaaacggaataaattcggttgttggtatagactgcctgttttacttagaatcacaaattgctccttgaccagagcaatcctgtgaaaatagaaacaggacagctctagttataccaaaaccgtccctatatttttggacattataaaagagattacccacagaacggttttttttatttaccgaactaggtaatactttatttgaatttatagtgcatataatatgagtttttaatacattctaatcgcataacatgaagtataaactcatgctaggtgattaaaaatgagaaaaaagaaagatacacacagctttgattttcgtcctttaggactggcaatcagagaagccagagagaaagcagggctttccagaaatgatttaggcgataaagtcttttacggagaacgtcatatcgcagatattgaaaatatcggaaaacaccctagctttcagttattccatgatttagttacaatgttcaatatatctgttgacgagtatttctatccagcgaagaatgttgagaaaaacacagcccgccgtcagatagattcgtcacttgatttattgagtgataatgaattaaaaatcattcaaggtacgattgacggtatcttgaacagcagagagaataagaagtgatttgcttcttgttttctctgttttcctatacagattcttcaacatttatttgttgatctgctccgcaggcaacaaataagagccgactatccttatttctttatcgtaaatttacttgttacacagtaatgaaaaaagccaatagtttgtaactggactttacaaactattgactttacattttgatgtccactcttcaatgaattatcatacgaatatatcttcaatactttataattcaagagtaataataaggctattggcatgtacttttgcaacaatatttccgccaagaatggcaacaagtgtttttactaccgcaagtcccaatcctgtacttccattatgtcttgatttatcgcctgtataaaaacggtcaaaaagtcgattgcaatcaatttctgaactgtcactcattggattttcaatggtaaatataatattattattttctttctccataagtgttatttttatcgttccaacagaatacttaattgcatttgtcaacagattttgtaaaattcgttctaccatatttttatcagaatatacgtatattgaataatctgggagatttatttcgggtaaaatattctccttttctaatgcaacggcattttccgtaattaaatttattaacatattagatatattaaacttttctttttctggaactgtctgctgttcctccaaaatagaaaggtcatagaatgtttctaccaattctttcattttttcggctttgctaaaaatcacttttacacgctgtgcttgactggattccaaattttctttttgcaataattgtaaatgaccaagaatgactgtaagaggtgtacgcaaatcatgtgatatattagcaacagattcttttaaatactcttcattgcgtaatacgcctgcaacagcctgtcgttgtctgatattatattgattcaatataccagccagtctttctaaatctttatcaatcaacgaaatgtctaacatctgctgtgaatttccagaattcaattcattaacttgatccgcaagattacggatttgtttttttaattgaatatatcgaaatagcagtattactaaaaatattgttatgataattaaaatccattctatgttagacattttctccacctatttaaaatcacatttacaaaattttatccacgaaagcaataccaatataccagaccatatacatcctactaaaatagctatcggttgaaaaaaggttttcatgctgacaacgattctgatttgataagtaggtaaaaaaccgactggtaatctcaacatcattccatagccaagatataagctaagaccaaaaataataattactgtaaccgaagttgcttttacagcatcctgtaaatagcaacaaataagtattgcaattagaaatatcgcactattaagcagacaagaataaatgattgcttttataatattgtaaaaaaacattcccacgtctgcaacaccaaagcgtccaaattcccttatgcaccctgaaactggatagacaagagccataagattaaaagcaattaaatacgatattattttacttgtaaaaatttgttttctggaatgtccagcactgacctctaagtttattgttctcttagaaaattcctgtcctaaaatcaatgcaagtatagccgacatgatgataagaagaaacgtagaatcatacaccattccattaaaaatatcagcaagagaagaagcaatttcttctgtcgatcccatgacctctgtaacataagtatctgctgtaaaaaatcctaaaataaatattccaatcataccacaccagtaaatagaattatgtaacaactgatatttttccagttttaataatttatccataaaaaacacctccggttatttcaagtctgtatgtaaaaaaacactacctgcaatgaaatataaaataaaattccataaaaaatctacaagcaagcaaaagtttgtcgaatagaccttttgcaatgaaattaacctaagttgtcccattggtattattctgctgattatttgtgcagattcaccgttcagcaaaaaaatcataacaaaaaataaaaccattgaaactgtcagtgttttccccatatcacgaaaaataaaagcaaaaaatatcggtaatgcacacagtgttatcatggcaaacagagttagtaaaaccatagtatatgtgctatcattccaaaaaagtttttctccaatataaaattgactaataattccatgtacaaataatggaaataccagaatgataatacaacctatttgagatacaattaactttactctaaatatagaacttcttttatgtccggcagtaatataagtatttaaagttcttccactaaaatcacttccaatgaacaatgctataaacactatactcaaaaaatagagtaacggaatattgtataatgatgccataattaagtttgaagagcgttctttactatctaacagcaatatgctacttaaaaggagattgaatattccaattccccaaaaataccaactgtgaaacaacttatataactcagtttttaggagatttgacatcttttgttcctcctattttgctcaaaaaatagtcctccaaagtatcgccagatacagaaagtcctgttacaagaatgtgcgattctgccaaagcagacgcaactgtctctaaatcattcaaataatcatacaaacgaattatgccatctggcattagtttaaagttatctgtatgaagattctcttccaaaaccagaaccgttttctgaacatctgttgttttaattgctatatgtcgtttacaccgttcatttaattcataatcagaaatctcttctataatttttccatggtcaatcagaataaattctgatgctgtttgatacaattcttctaagatatggcttgaaaccaaaatggtcataccatattctttattcaaaatttttaataaatttctaatttctacaattccagcagggtcaagaccattgataggttcgtctaaaatcaatagttctggtgtatttaaaagtgcaatcgctatccccaatcgttgacgcatacctaatgaaaaattgcggacactctttttacctgtatcttgcaatccaaccatatctaatgtccttttaataactgatttatctggtatgccgcgttgaatacgctgtacttccatattttgataggcagtcattgacgggaatagggcaggcgtttcaatcatacttccaattcgtttacgctgtttctgcaattcttctgttccagaatttccccataaagaaagtgtaccacttgttggaaacgcaagccctgtgactaatcttaaaaaagtagtcttacctgctccgttttgaccaataaatccataaatttttcctttttttatttgtaaatttatgtggtctaatgctaatgtttgtttatattctttggttaaagactttgcttctaaaataattgaactcatatcccaaacctcctttacttaaaccagtataacgggcaattttaaagaatttcttaaatcgtaatgagaaaagttaaaaaaataataaagctaaggaacgtttaatccttagctttatgtaggcggtagccaatgccccaaacagtatcaataaattctgtatcagagcatatcgcttttaatttattgcgtaaattactgatatgaacattaagtgtattatcttcagcaatatattctgtatcccaaacactttgaaaaagattcgattttgaaaatactttatctggatatttcatcaacaattctaaaatgccaaattctttagcggttaaggataattctattccattcaaaaatgctgtatttttctctaggtctaaagtcagattgttatattgcaaacattctgtctggctattttgaaattgtactcttcgcagattactttcaattctggcaagcacttcttccatatcaaaaggttttgtgatataatcgtctgctcccagacgaagcaagtcgattttattttgtgtagtttctttcgctgaaataataataacaggtatcgtaaatttcttgcgtacatcagataaaataatatcaccactccgataaggaagcataatatcaagtataatcaaatcaattttttctttattcaaaaaatccagaacatgaagtccatcatattggcaatgcacagcatatcctttttcttttagaaaatcagccaataacgcatttatttctaaatcatcttcaataatcaatattttattcattagcctacctcattcctgcaatgctactttcccattatacatttaaggttgtatttcctcaataccattgcaaccaattatatgagagggattcttattttgtcaatctaattgtaagcagaatagtatagattggataaacaattaccatactattctgctgtaatatttattctacaatcttccagttatcgtccttatgtaacacaagctcatactgtgagatttgcgtcattttcgacttgttatccagatatttcacagacacgctgaccttgaggttatcaccgtcttcggtaaagacagggtttaccagttctgaaaatacatagtcgccggatacaggagcaagcacaccgtctttgacatagtaggcaagttccttttccgtagctgttggatagagtttaaagaatgtttccaagaaagcggtagcgtccttgactgtatcggaactgacactgacatcggattcctgtgctttcggttcatactttgatttctgcactgtcggagcaagtgtcggattctgggtaatgaccattgcaccgtccttatccatatgaacggtcacggtgtagttttctgtgactgcctgtgtctgttctccctcttttacctgctgatctacttcgtaggcaacggtaaaatcgtccgttccagactgttctacattccagaccagcacatttgtaacggtcgcactggtcggtatgtccgttctgatggtatcggcgttcaagtcctgtaattctctggtaaggtatttactgatttctgttgtccttgcttcaatggcttccttgctggtatcccatgagtagtaggctttcgcaaagttcttgacgaaattctcaataccgttggtatcgttcaatattagctgaatgatttctttttcatgtaccgtgtgggtgtcaatggcggtaaagttcttatacacaccaaagctggtgcttgccagaagcaccgcccacaacagcaggacagatttcttgtgtgtcccgacttttatggtacgcactttcttttctttgggttctttcattgttttttctttcttcttaaacatatttcaagtcctttctattgcttaattcttccggcacaaatgatgtgctgttgccagtaggcagaggtcaaatcagtatagccgattggatttccggcatgatacatctgattgttacccacatagattcctacatgggtaacatagtcactggtgttgtaggtggaatggaaaaagaccaaatcgccagcctgtgcctgtgacaatgggatatgctgggttgcgtcatactgtgcctgtgcgattcgtggcaggctgatttctgcttttccgtagcaccactgggtaagaccagaacagtcaaaagaggtgttcgggttactgccaccgtagacatacttccaaccttgatatttcaatgcttcattcataaccgcctgtaccgtttcgttactgaactgttttatattcagatattggttgaccagctccacataaaacatatttccgtagttataacgccagccaccatttttactgacagctatcggattggtataggtcacttttgtaccgccagatttgtttcttgcgaaattctctgcaaggttgaagctgtgctttttcccattcttcgccacatagtcagcatagccaccgccatagttataagattgaatgaccacgttaatgtctgtcatacctttccctttacaggaagaaagcagggacgcaaaatatttacacccctgcttgatagattcctctgtatttaatgagttcggcggtaaccccagactttcactggactgcatgacatcggtagctgtaccgccactttccacctgtatgatggcaagcaggacgttcacatactccgaaataccgttttctctggcgtatctttctaccatcggctgatgtttgaggacatcggctgacaggttcatgccagaatagacaggcgaatagctgtttgaattgtcgtcatcttcgccggaaatcaatatcccgaaaaagaggacaatggagaaaaggactggaaatatcgtacctatgataaggatacgttttaatctcatttcttccgtcctttctctagttgcttcgtaacagtcttacgattctgtttttggttgacctgtttctgtacagtggttttctttcgattacttctggattcctctatgtttgtctggtttgttctggcaaccgatttgacctgttgttcctgtctgatgttggttcggatagtttcttttccagccttgacttctgcattttttatcacaggagaagtaacaggacgtttcatatctggcttcgtaactgtatcggtcggtgcaggttttggaacaggtgtggcaacagggcgttcatggcttctggtagctccggctgtcgctgatccattcgcatgaactgtctgtcttgcttcctgtgctttctgtaattcctgctttttctgtgagatattttccctgtgcaggttacgtttctgtgtacgctgttcctgtcggttttcccgttcttccacaacgccacgcttaaagtcagatacgttatcctttgctttttgtttggcagagtggacagcataaccagcctgtgtcggcaagtctttcacattttctttcagagaagaagcactgtcacggactttatttttcgtatccatcacagcaccgacagcagaaccgacacggcttcccatgctggcagaagtattttcccgtttctttggcggttggttcgttgctggctttccggctctggcaacacttgcaccagccaccgcacctgcaacacttccagcaccgacagcccttgcaatcctgtgttccatacgtcttgcccgatgtcgcatgaacaccatcggtctacggaaaatccggcgacctatctgctggctgtcattggcattcaggctgaacatactcattagttctccgagcttcatgtagattccggcaaaacagattatctgcaaaaatgccaccatgaagaacggatagtctgtggaaatgttgtaaaacatactggaaattgaaaatgccacggtcacaatcagtgtgattccggctcttgtcataatggcattgaacacacggacaactgcctgtttcgccatgttctcataggtcggtatcatggacagtaaaaaactgacaggtaaaaatatggcatatatgataaagagtatctgggaaaacaacatcatgccagtaagcaggaagataaatattgtgataccgagattgaaaatgagcaggaagaacaccatgccaagacggtttacgacctgtggaatggtaagattgtcattgtcgttatcctcaatctctgttttgacaaccttttcccttgtttccccatcttcgtctgacggactggcagataccagagcttccacacggtcagtcccgatttcttcggtatcgctgttcccgaactgcaacaacagccacggtttttctacctgtatcgcaaaaaggctgtcacggataaggtctacgctgtccttgcctttgctttgtgaatcggggagcatgatttttgtccccaagtccagagaagcggtgctgatgtccgaactgaaatcattgattttctggatataattgggagcataagcaataaaggacgcagacacaatgaacaccaccacaaagttgataacagcgtgaagtgctttgcttgtttcccgtttgagaagccctgtataggcggtgtaaacacctacaatcagaatgataatgagcaggaatcccacatagaatccactgctggaaaatcctttttcggtcactccggcaagtgtctggatacttttcccgatactgtctgccatgtcattgatgaagtccagcttatacgcctgttgcaccacatatcctgtggcattgctaagatacaggctgattgtccagacaaaatttgtgatacagtaaagcccgtactgcaccgattttccaatgccgtccagccagttccacggtagccaagaccagctattgtccacatagaaatcaagctgatagttggaaagcggatactttgaatacaggttgtctgcattgaccgtatcatcgaccagtccagacgcatgagctaccgtcccaagcagggacagcagtaccagcgtaacggtcacggcaagcagtaccagtttcagtacatggaataccttttctcttgtgatagattttatcattccaaatccacctcactttttatcggcggtctggtatcaaaggcatggagcagttctacaaagacagggtgtatctgtaccacaccgacacgcccgtataaatcctgcattaagcattgtccgttctccaaatccctcaatcgtttctggttattttcgtcctcactgtccagtccgaaaaactctaaggtctgtttgatttcattggtatctgtggagcggaacgcaaactttaagccgatgttatttttcagactttctttcgatacatccccagaggattgtgtcacgaaatagactccggcgttcatggctctaccagcacgcaccagcttatttgatagtgtttctccctgtgccacatttaagaacgcccatgcttcgtccaagtccacgattttaaaaatgcttcggtcactgtgaatgaaatcaagggcaaaggtgctgataacaattaagatggataccgacaacagttcaatggtcgtgtattcctcaaaggtagtatccttatccggcagaaccaaatctgcaacctgtatgatattgagctggttatccagactgattgcattttccaccgaaccgtccgagaataaaagctgtgcaaaatcatagtcggtaaaactttcgatatggtctgcaatgttacgggatacggcggtatcctctttccgcagttcttcaatgacctgcaacagcccgtggttctggttctgggatacggtacggacagcttttctaaggacagggaacttttcgccatcacgactgctgatacctgtaagaaatgtcagaatatcaatggcaagactttcagcgtccttgacatctttcataatcacatacgggtctaacagcccttgattgctggaatcactggtaatgtttacaatgttgatttcctctgcaatctccggcagtgtttctttccagtttccacgctcacttttcgggtctaggataactgcctgtccaccgaacagaacggaataatacaccagcagattattacagaatgattttccaccaccaagcgaacccacaaaggcagaagccaacgcatttgtgaccgtaccttttaccccttgactggcaagggacggttgcaggtagacatttcttcccgtatccacggaatatccgatatagattcctgtattttctcccaacatctgggtagcaccgaaaccaagtccggctaaaaagtcggatttcacatactggatataatcattgatataacgtttgctggctggaagaaactctccatgcagtcccatcatatctccggcaggacgtaccagcttcacgttcaaatcatcgtaaaagtccttgacttcatcacaacggcgtttcagttcgtcaagatcgggtgcagacacccgtatgacgtaacttaacttatacatactttccttgctctggtctaaatctgtttccagttcatcgacactgtctaaggcttccaccacatttgaacttgtttcatttccggcttgataggcgtgattatccaagtcctttaattcctttttcttgttacggacagtggttaaggctttcttatttcccacaatctcaacattcatggaagtatccacagggaatgtgaactgctgttgctggaaataaaagatttccgatgatgggaagtccagttctccgacaatcgcattgaccgtaaagtaggacacataactttcactgtcctcatgttccagacgcaaatatcgctggctttcttccaccacacaacgggtaggacggataaggtcataatacttaatcagtgtttctttttttaattttctttttggaagaggatacacataatcttcgtaggctatcccgtccctgccgtagaggtgttccatcagatacgcaaagtctttggcttccagtcggcggattttgaacctacgggagattttgttttccagcagtttttccatcttcacataacgattgatttcatcattgctcatagaaacaaagtcgttcatcagcgtatgccttacctcattcaaaaactcacggaatgtcagaaataccgattttttgatgttcttcagattgacttcgtcctctgtgaccatgagcttgaatcccagaaagaaacggtaatccacttgattgtcgcctatcatggatacaagggcttcggtctggtcgtctatcttttggattgctacctcacggagctttccagttaccagcttctttgactgttcctgtatgcttcggattgagctttcagttgcaatctgcaacgcatgaatctttccctcacgggactgtgcgataagctgacggaaattgtcatgcacaaggtatttctgctctggggataagaatgaataattgtacggtatcagctcatagtaggcgaacacctcattgtccttgttccagacaaggttgttgtcgatatatttaatcgggaacataggtcacactccttactgccgtgatagtttcctcaaatttctgcttatgcaggttcacggcttttccggcataagtcactttgggacgcagggcatacagaaccatcgtcttgatgtaactgtatggctttttcccgtcaaaggttttctgtgacataaaccatgtaagggcaacgggaatcccgaaatatttcaaaaacgcaccatcaatcatggaaagtggcggtacatctgcaaacagaatgatgataaattccgtcagcacgaaccatgtaatctgggtaaaggtcacagggaatggcagggttacatcattgatggcatacagaaccttttccacgttccagatacttgtataacttcggattttcttcacttgtaaatgctcctttcttcattttcataacaacagggacagccggatttcccagactgcccccaagagaaaagctgacagtagcaccagtggcggtgctgatctgccagcccttaacgcagtacctcacagataccagcgtttgttgcaataaatgtcccctctatatcgaggtcacgcccgtaagcttcatagtcgatatagttctgtaaagagggcgggatttctccaagtacctgttcttcatcaatcagatagtaggctaaatcggtcatcgtttcacagccggaatacagaatgatgtcgtccttatgttccaccagctcttccagacttccatagcaggatataaaactgtccaagtcgtccagcaggtaatccggtaattcttccaactgctcatagatacggttcagttcttcgatggaaatgtattcgctaatctccatcgggaagttgtccgtatcatggattgcgtattcttcgtactctgcatttaagccgatacgttctgcaatcacttcttcgtccaacggaaaagagaaccagtccccgaccagttctccctcattgtacttgccaagattggctatatagacttgcatatcatcaatcataagcggtcacttcctttcactcattgtattcataaaatctgccatgcacacacaggaaatgttctgatgtttcttccatatctgaacagttccgatggtatgtaatattgcaaagtccggcttccagctcttgcaggtttgaaaaccattctctttgaattgcaggtatatcttcgggtgggatttcactctccgaaatcgcaaggcagacattatttagcaagtcgaggtctgtatcttgcaggatttcaaaaggaaaatcataatcactgataagataacggtcactgtccggcggtaaaccaatggattgttttaatgcttctatgttgcagggaagtgtaaaccacgcacagcctgtatctttttcctgttcatcaagattgataacaaatactttcatttctgccataagcaataccacctgtcaaagtttgaacataccgttgttgcagagagcataacgtcctttttcttccagttcatgggcgtaggcttccagattaaaatatttctttcctttttcggaaagagcagaaaattcaatgttatgctccaagcggtaacgggcaacgtccatgatgttgtgacactctggataaaacaaaaattcttcggattcctgcaataaatcctctacaccgccacaataaggaatcaactctttgtatgcctgctgaacttctggcgataaatccgtgtaagcaaagtatagcttgtttaatcgtctgacagaagttgtccttacaatatcgccagcaaaggggagcttcatatctgtgatttgatagtctttgctgtcagcttccacaccgagcaggtcacggaacagctcataatcaatgggtaaatcaaaccagcgagaggttttatcctctgctgatttggtcgtttcaatcaatacgctacattcttccatcgtaattcagtcctttcttctaattttgagtatgaaaaaagcagtcgatcataactgaaagactgcttaactctaaaacaatattaaagcgtttcttcttttaaattctgactcaaaagggattttaactcttttacatcattttcagacaaatcattttgattaacaagaaccatttcattttttattgttctgatatatatgtaatttctgaaaatcccccaacatttaaaggcgttccaatgattagtcccgttaccaatatcagaactaactgcaactccatcggtatcaaaacaatattcacgttttcccgaagtcagtttattatccatctttgaatgaacaatatttattacttttttctgaaatgtgttagctccgtttatgataatccagataaagaaaactgaaaataataatccaataataccatagccaatacgactattcataaagcaaagaatcgtgtatattaacattatgacagccatcacagacgataaccctgttgcaaatttacgtttctttacatttttatcactggctaaaacgatttcttttaaaatatcttgttctttctgtccgatttcaatactgtatctaaccataataagaatctcctttaaacattttaatgatattagtatattaccacaagtttgtgttcaaaatgtgggattcttaattttacgctccaataatcttattgaataactgtaacaatacgtcttttacgccggatgcattgaatacaagaccaacggctattaaggcaactaccaagaatccgatgagtttggaaaactcacgcttaaatcccaagtagataccgataacaacaatcgccatcagtacaaggctctgtgcgttgcttaaaaaccagttataaaggttctgtccaaaattcattatttcttttctcctttcagttccatcatttttctgtcagactgtctgccagcctgtaaaatacacatggcaatcacgccaactgttccacctaaagagaagagcaggaagtcaaataataatcgttgcatttttcaattctccttttctaaaatcacatcttcggtagatgtggtctgttgttcgattatcttgtagtgcttttccgtcagttttgtggatttacggatttctttcagataatcaacgcctgtttttgctgtgattgtttccagcattttaagtgtcgggtcaacctgccgttgaatccagcgtagagttctgtccagtgtgtagggttcgggtttggtcgtgagctttaacggctctctgttttccccgatgaaccacgcccagcggacagataatttccagtcgctccgtttcttgtctgcttccttatccacaaagcgtacataacggttgataatagaaaatgccgtccgttcagcgtcatagtaagtcagcaggtcacggacagcataataagcacgttcatttttcaaccgtatttcaaatctgttttttatgggtgcttcctcaatgggaatcccaagtttgatgtactgctcatagcttttttcatagacacagaagtacacctcacttttcagtgaaccgatataaagcgtataccccataccagccttgtcctgttcctcatgcttgaccagttcgccggaagcataggacttaaaggaacggaacaccgatacacattcctcattccggcatttttcggttagttctggaatatctaacattcccgtatggtcattgatggcaaggtcaaggcgtttcatcacaccaccgtccaccagagcgtccataagaaaatcataccagctccgttcctgtgccagcagataactttcaaactggcgacagccttttcctttcagttccagcaggacacctttttcttcatcgggagaagtatatacgaaaatatctccgatgtagtagtgttctgtataactgtaatgcccgaagtcctcatgtatcatgtactgaatattgagctgtaaaatatctttgatgatgtgtccaatatccagtgtcggaaaccgtatcctcacataatcaaacagcatggtaagcggtgcttctggattgaatttttccagagcttccaaaagtttcactttcatttcttctgtgaccgccaccttgccggattcgatacggcttaaatgttcacggctgattccagccatgaccgcaagtttcgtctgggatacaccgtactgcaaacgtctgtctgcaaaatcctgtatccactctgtatcattcagtgcgataccccctttacgaaaaaactgtgacattttgtatccgatgtcacagcagtaaaaaaagctaccaaacgcttgatttgagccaagaatcggcaacttttgtgtatgtttccttgtgatttgtgcccctctgttagataccgaggggctgttgtctgctggcgtggctaccgccacaccagcaaggctaatccgtacctgtggctttcgcttcgcacgccacctgtccgtcctgccttatgtgtgcaagttccccaatcgtacccaagaaatcatagcctttgggtacaaggggagtataaaattctgatatgacgcttgttcccacatcacagtatccacgccctttgattcgcttctggaaaaactgtttttttacatcacttccaaagagcataccgtagccgagttcactcatgcgaccaagccccacacggaagttaaagttatctctgataccgtccccgaaatactttgcgtctggacgctggcaagccacaatcagaaagtatccagcctgtctgccgagcatgacaattttctttagctggcttaacagtgcagtgctttcttttgtcgtgagcatttccaagaacgccacatattcatcaaagataaggaactgtggagcaagccccagataggcatagttttctcctgtgcggtagttcgggtgcagtttcatttcttccgagcgtgtgaccatgccctcataaaaggcattgacgcagtcaatcatatcgtctttcgtgtggtagacatttcccatgactgttcccaagtctgcaaggtcagcgttcttcgggtcaagaatatataaatccgcattggttctaagcaatgcttcaatgatggtcagcaaaaaataggtctttccaccacctgtaccaccgcagataagggcatggggaagtgaatcatattcccacaccagatttttcattaaccgcagaccgccgttttcggcaatcacttcatcaatcgaaatacggttcgctatcatatcatagagcagggtatattcaatatagccgtcatgcagtgtcttgtcggtcagctcacagtacagccccgattccagtttatcctctaaggacaggagctgttcttgatattttcccattgtgatttcacacaggatatggagcaatcctttgtccatctggtagtagattttcggaaaccacacgattttttctcttgatctgctttgcaggtcagtgaaaaaatcgctgtctttggtgttttccgcttcataccatttgttttccagcaccatacgagccagtttttgtcggtgtaataacctcttgatacggtcatatccgtaacggtagtagagaaaagcgactaatgcacaaacaccagtcgctatcagaaccgtaatggaattgtaggcagtccaagtaattccggcatggagcaggttacaatctttccagtctgtaacaagaagctgtcgcagattcagtaacaggaacaccgcaacgaacaggagcaacagccagccgatacagaaatgatagaccagagatttgtcactggcacgaatcctgttacctttaaatttccatgttttcataaaagctcctttctttgggtataagaaaagcagtcaatcttatagactaactgcttttacattaaattttttatctttgtatatgaccaatttttccataattatctagcgaatattttatcaattcataaatttcatctttaagtacatattgatattttgcaggaattgtttcataagctggtaaaggaataaaatttgatgatgtattttcattgtggacgaatgaaattggaacttgtttagaagcttcaatttcagttcgatgaaaccaattagaatttaaaaatgtctgttgaaagtcaattcccgataccgtgataggtgcgttttcattatctacaaattcgagtaattgtttgtaatctttcaaagacaatttatctatttctgtccaaagaaaatctatagccttatcattctcttgcttaacgagagcttcttgatgttttttatcttttatcgaagcccaaaatcccttgactttatctattccccagataattaacacaattagtaaaaaccacaagcaaaaaacaaaaacaccaaatcctgtagtagtaagttttgtcaataatgcattgtctgctggagttttataatatgtaataaaagccaacacaaccgcaattatcgttggaataaaatatttttccaaaaaaatttttaaagtatccagcaatttctcaaccatatttatatcacgtcctttgtatattttaaggacattatatcgtcaatcagcattacttgcaatcaaatactaagtaggttttatttgtttctattagctattgttttatcatggtttggtgttacattttctcccaaattacttttatttttcataacaatatcgtctgcttttacataccagtccacatctgcaccacggtaatttgcattggctaccgtatctgccacagggttgataagttccacttcggcgttgtagtcatagtcctttaacggcacagtcgctggaacggatacctgtatcatgcgtccctgtgtgttgcatttcaaatcgtaggtacgttccttaatttcctcacttaccgttccatcttcattttgtacatgaacctcacggcgtaatgcggagaacttcaacactccgaaagtcttttctttatcaataacgattccatttgctaatctcataatctgaatacctccttatttactttctgctggtaacatatcgtctgcaagcaggatataattgacaaatccacgttccccgattttatacccatcggtagtaatacgtgggttgataagttttactttctgctccggcgagaaatgtttttcgccagctttggcaggaagtgtcacaactacatcatcggctctctgcacatcggaatacaggttgtagcttctggtaatgacagccatacgcccgttgattctctgctgttccgtagtgttttctccggcaaactccaagttcccgaaagtctcttccatgtttggtacgacaaatcttaattccataaataattgacctcttttctttcagttttagtttctttcctgctgtacgttgtggggagctacactccccacgcccctagtggacttcacgctcctgtaaaccaagtgcttcacgggagcgtgaagttgcaaaaagggtggcgaccttgaacgctctaccaaccgctaccttaccgccttatgatttctttctacggcgtttgaagtaaagcataccgccaagccctacgcaggaaagactgagcatgacaagataagcatagatattggtattgtcgcctgtttttggactgtcacttgtcttagtaatcgtagatggtgtatccggcgtgtcggtatcctttggtgtgtctgggacttccggcacttccttgattgtcacagtctgtccatcgtctgtgatgtccttatgttccgtcactttctttggttcgtctggattagtcatatcgtataattcctcaaatgtgacaaggctcttgccaccaagaaaagaaccatcaaaggtaaaggcaatctcaactgtcattttttcattgtcggctgtaaactcataatcattggatactttctttccatcaatcagaagttttgcattttccttttttaacatctgccagccggaaagtttgtattttgttccaacttccagaccatctaatgtgactttatccacaatcgttacatcttttccggcttcgatttctttcttgccgttcttgtccgtagcggtagtatggattttgatgatacgttccgtgataagaacggtctgtccatcatcgttgatgtccttatgttcggcaaccttgacaggctctttcggattgctcatatcgtacaattcctcaaaggtaacaaggttctgaccgccaagagctgaaccatcaaaactgtaagtaatctcaaccgtcattttttcgctgtcagcagtgaaagtgtaatcactgtctacacgtttcccatcaatcagaagttcggcgttttcttcctttaacatctgccagccagaaagtttatattttctgcctgtttccaagccatcaagtgtgactttgtccacgatcttgatgtcttttccggcaacaatcattttttcgcctgttttcttgtcggtagctgtggtatggattgtgatttctttttcgtattcatcggtcagtgtccctaaatctacggtcactttatttctggatacgaccacctcaaaggctggaatcagcttaaatccggcgttggaatcacactttaattcctcaatcacataggtatcatagagtaatgcacctttgctgtcgtctggttcagatgtcccaaaccatacaccgtcctcactggattttccggcattggtattgaccttgtgggaagcccagcttgaagcagtagagaactgaccgtttttgtcagtaactacaatatgggattctcccgttgtcttgcttgtaattctgaatggaacacctgcaagacgtttgtgtgtacctgcaccgatttttacaccctcaatatcgccacgtttaatctggttgtagacagagtgggatttgtcggtcaagtccacgatttttccatcttccgtgatagaaaagtcgattgcctttgcaccatctgtcaagtagccctctggtgctttgctttcttctaatctgtaatttccgtaagggagcaagtcggcagaagtagaagcaattccatcaatgcctgtctgaatcttctttacggtttcattcttgttgtataattttcccacaaccagtacaggactgtcatttaaagaaatgatattgaactctgtgtactgtaaggtcgcacttccctgtgctttggtatcctttgtttcaaggtcacgtttctggatttttacaccgccacggataaccttgtcagatacggaatactggttgcttccagaaagtacggcaagttctccatcttcggaaatctgtgtaaggtacgttcccttaatctgttcggaacttccgtcagcctgcatatatgcaccatctaataagtagccgtttggtgcttttgtttctgtgacagtgagtgtaccaagtggcaatacatttttaccgtcctgtgtatagaagctgtcgccggatactttgtagctgtcggcaagtctggatacataatggatagttccgtcactgtctttttcggcaacggttttggttgtccatgtacgggtagcttttgcaggaagattgtctgcattgtagtaaccatcataatagctccatgtgaactctgcaccctctaaagaagcagttccttgtggactggatttgcctgtttccatgtcaattttgaataaatcaatcaaagtttctgtaacttttggagtgtcggcaacagtcaaagtcgctgtttttccaacttccacatttaaggcatggacagtagaatccagcttgtaaccttttggagcagaaagctctttgatgtaaactgttccggcttttacctcaacttctttggtatcgccgtttccatcggcagtaagtgtggcaagctggctgttacagcccttatcagaatagacaccaaatgtcgcactctcaaaagaataattggcattgctatctgtgacagtgggattggaagaagtctttttgacctttgcatttcccacatttaacttcgcccagaactgtccgatgtcctgtccttcgccagtgtaaatgtaaccgccacattcatagcgtcccttatttgctttcacaaatgctttcgcaccagcgtacacttcattctgtactgcctgtgagatttcattataggaagctctgacgttgtcgcactgccagccgagctgttcactcaatctctgccagacaacacactgttccagcaaatatccctgtttgtaattcaagttcgtatgagaagcggtatattgcttgacgtactctaaggaaagagcaacgtccgcaatctgatcgctactcatacgggtacttgcgtcagagcgtgttttatatccattcttgaaattggtgttgatgtccacgcagtaggcagtttcgccctcaactttcatgtgtccctcattgaatgtggatttgatagaaccatcattcataacgtgttcaatgtagccgacacgttctgctgattctgtccagtattgattgccggaagcatgaaccgccgtcactggtaatgctgtgagaatggttgcaaaagcaagtgttcctgtcagcaatcgctttactagcttattcatattttctctttctcctttcgattttgggtatgaaaaaagccgtccatttctgaacgactggaaatagaaaaggaacgccaaaagtgtacgttccatagtctataaaatatttaatttttctctctagtgtgctatctgacgccaattttgaccccaaatttctgaaaaatgacgatttttgatgaacagctacaaattttcaaaatccgtgaaacccttgtaactagggcgttacgggactatatgaaactagacaaaaccaacgtcacaataacaataggtgagtgctaattattttgtgaagattttgtgaacgaacttgcaaaggcgtctatttttgctattttatagggcgacagcccggcaacgaggaaattctttcccgagctgtgcatggcgtatctctcagcttcccagggatttttcacttgctttcgcactcgattttcttgatttgaccacatttttacgacaaatcttcggaaaaatatattcgtctgattttcttactacacttctccagcaatatcatattttctgacaaaattttgtactttgttccactcttttctaactgtgctttatacttttcacactcctgtacaatcgctttttttgcatactctgtcgtttctccatcatgatttgaaaaaacaatgtctaagtgatacaagctgctttaattcttttcattgtaactacatctctttcaatttaaagatacgtcacatagaaaaagggatccttcactcagtaaatttgaatgaaatgatccctaattttcatgtaaatcgtacttggttttacaatactaattatactttattttttgaaaaatgtaagcaaatttttattttgcacactcaataattatcgcttcacatctgtcatatccaagctgtgagctgttcagacacagcgtataattgctcgtttttccccatttctgatccgtataaaaattataattcgtcatacgccttttatctgtatctgccatcattttgacagcttccttttcttctacattatataaccccataattcgctttgttttttccggcatatccccatagataaatacattcagcacatcgtccctatccttcagaatatagtctgcatttcttccgataatcacacaagattccttatcagccagttctaagataacctttctctgtgcctcatacaccatgtcttctactgattttcctgtaatatcacgtccggcaaatgcatatgcaaataatccttttttcggagataattctgcatttttctgaacatactccggtgacaaaccggacttctctgcaatgtcattaataatatttttatcataataagcaatcccaagtttcttcgctactttttctccgatgaaacgtccaccgcttccaaattctctactgattgtaataattcttttcgccatctctgattcctccttaattcaaaacatctactttattttttctgattctctttaaaaatacataacctgcaaaacatgaaactatttcagtaatcggaaatgaccaccagattaatgaaatgcccatctgtccatttctgacaaacatagaaaaaattccggccagcggcagtataataatgagctgtctcaaaagcgaaataacaagggactctataccaccattcagtgcctgataaataccctgataagcaatattgatgcctgcaaacaaaaagctgactgagattattctcattgcttcaataaaatattctcttgactgtcccgcattaaacagcgttgcaaatgctccggggaaaatctctgtgattgtaattcccagaatcattaacacaattgtatagatcagaccatatttgattccatcctgaattctctttttacttctcattccataagcaaatgcaatgatcggggtgatcgcatctcgcagaccaaaagcgagaaacagtacaaactgctgaactttataaaataatccataggctgtctgtgctgctggattgaacttcaggatcagattcatcacataaaccataatggacatcaatgcctgtgcaatgattgccggaagtccgattttatagatttctttgataattccgccatccggcttcatgtattttgccccatgctcgaattccttattgaatttgatatgaaagataagcaataatactgcggatgctacctgaccaattacagttgcataagctgcacctttcactcccatttccgggcaaggaccaataccataaatcatgatcggatcaaggataatatttacaacggctccaaccacctgaccaattgtggaataaagagaacgacctgttgcctgtaataacttttcaaataaagaaaagaaaataataccaaaagagattacgcagcatatcctcagatagctgactcccatctccaatacttctgtatctactgtctgtgatgaaatatatgctttcaccccaaagataccaaacagtaagcagaccacataaatgatcactccaagaaacagactgtttcctgctacctttgctgcttttttactattcccttgaccaagtgtccttgccagaagtgcattggttccgacacccgttccgattcctactgcgaccataagcatctgaaccgggaataccaaagtcaatgcatttaatgctgcctcactgcctactctcatatttcctacaaatgcactgtctacaatgttatagactgcctgcaatgccatagataggatcatcgggattcccatctggaccatcagcttatttaccggcatctccttcatcttgttgctttccgccattttttaaactcctttctttttggcacaaaaaaagtgcgcaccttgtcatataagctggacttacgctgacacgctacacactttttcatggcgatattgatttttgcaaaatgaaaacgagtagctggtaaactggatttacgcttacttgctactcgtttcttgtaattatatttcctctttttcaaaaagtcaaacaaaattttccttacattctctcttctttttacgcataacaaaagcgggtgatgggaatcgaacccacgtatccagcttggaaggctggtgttctaccattgaactacacccgcgtcttaaagacaagtaatatgatatcacatctcagaaaaaatgcaagccttttttttattttttgatcacttttattactttttgtccactttattttctgacctctattttatctatttcggttcttttccttccatttccacatatattttatcaatcacctgttttctatccgatcggagttccttttatgttttccagattaaaatcaaaaaatattatacggatctgttttcttttcctcgcggctttctttgtgggaaccggcgctgcatttctgcatgatcatttctttccagccgctgttcccacctcttctgaaggcaactgggggctcagcttccaaacggatggggatccccctgtcggcaatgccacatttgacgagttgaaaaaatttgatgccttttacgcacaggacaccggcgaaaaggtaatctaccttactttcgatgccggttatgaaaatggaaatacaccggctattctggaagctcttacgaaacatcaggctccagcaacgttcttcgtcgtcggcacacttctggaaagcaatccagaacttatcaaacagatcctcgctgccggtaacaccatcggcaaccatacctggcatcacaaagacatgtcacagatttctacaatggaatccttttctgaagaaatccagacagttgaaaaactgtatcggcagatcaccggacaggaaatttccagattttatcgtccaccacaaggcaaatacagcgaagccaacctgaaaatggcacaggatcttggctatcataccttcttctggagtctcgcctacgtcgactggtatcaggatagccagccatcccacaaagaggcttttgaaaagctgcttgggcggatccatcccggtgccatcgttttactccacagtacgtcctctacaaacgctgaaatcttagatgaacttctcaccaaatgggaagaaatgggttatcattttgcttctcttgatgaccttataaaagctactgcatcttaggaatttttctctgtcactttatcggaggattctctaatcgatcagtccatatttcttcatcgcataagcaattccatcttcttcaacggtctttgtaataaattctgtataaggttccagcacctggtcatgcgcgcccatcgcaatcgcatgcccggcatgctggaacattgccagatcattgctgctgtctccaaatacatatgactgatctctcgtcattccaaaatgctccagtacccagtcaatcgcagttccttttgtatagcccttgaggatacattcaaacgtattacttccacggtcgattacttccatatcatctttgataaattcaaaaaatgcttttacatcacttttttcatccgtataaataaagattttatcatatggacatcttctctgctccatataacgctcgattccaagtccacggttgttcatgtatttttttgtattttccaatctgtcaaatcttgaaactcttgaagtgaaatacacatcttctgctccctcaaaaatcccatcaatctgacattttgtcatataatcagcgatctcatcgcccctctccggatccagatgcttttcaaaaataatttcttcatcaaatgtaaaataaatcccacatccacacaaatatccatcaaatggaagttttttcagttccaccggaacactgcagtatgttcttcctgtattgataaataaaaaatgtcctgcgtcgtgtgcccttttaagtgcatctaccgtacttgcgggaatctcttttgtaatctcactgagtacggtcccatcaatatcaaaaaataatgctgctctattcattctaccttttcctcccggttatactccaattacacgatactcattatactcatatctcaccattatgcgcaaccctttttcattttctgcaaaatatctgtgataaataccattttgacttctccatataaaagtaatataatagatgttgtacaatttgaaaaaggggtaataataatgaataaaagaatcgataagaaaaaacagaaaagaacacttgaatcagcagtaactgctacagctacatcatcagcaccggctacagcaactcctgttgtagagataaaagaagttgtaaaagaagtcaaagtaccagtagaagttcctgccaaaaatcctgcattttatgttcagtaccagagtgcagaatatactgtagccgctatcacagaacgtgtgatcgctgactgcaatgcaaagggacacgctgtagaaaatccggaagctctctccatttatctgaaaccagaagataaaaaagcatattacacccttggagggttcaatggatatattgaattataaaggagtattttatggcgcttaactttcaacagcttggaatgcttgcaaaactgaaatccgcattttccacttttcaacagcagcatcctaaatttatgccttttattcatgcagtaaaaggagatgcatgccgcaaagacagcatcatcgaaatctccgtcaaatctccggaaggacggaattataccactaatttccgtgttaccgaaaaggatttggaacttatccagatgctgaaagatatgcaggaaaaccaataaagtatacaaaagcaggtaagaaaggatagaatttcttacctgctctttttttatcttactttagcatttctttgctaatacaaaggaatggccttccatttttattgcctgaaggctgacttttttaccggtatataaatccatatactctccctcttcttcgatccaggctgtccggtcctcttctgcgaaattaaaaagtgctgtcatctgctcgccctccagttcccgcacaactccaaggattccattttcccaggtatcaagcgtccagacatttgccgatgcgtcaaatactttttccttacttcggatggatctaagttttccaattccatcaaacagttctttttgtaccgttccgtttctctttcgtccgtctgccagcttccagtcaaattttcctctgtggatatacctggaatcaacccgtttttccggatcatttttataagtataatcatttacctgaccaatctcatctccactgtaaagcattggaattccggattgcaccatcatatatgcatgcagcatcagatcaaatctgactgctctttttttcttttcttcattttgttcaaatccggcactttcaattccacacatggaagctgtcgttgcacagaatctggcatctcctgttatcggatcttcattataaagttccccgcggctcacactttctgcgatttttcctgtgaaaaagtcattcagatatcttttgtgtgggacttcctgcattccccaaccggcaagtgtctggaaatccaatccccatccaatatcatcatgacatctgaggtaatttaagaaagtatactctttcggaaggttgttcataatatcaagctgcatccgtaaaagtctggtatctctcgtcgcaaccgtattccatgtagtagccatcatggttacattataaagcatatgacattccggcttttctatggtaccaaaataaggaactactttttccggttccatcacgacttcccctaataatacaaccgacggacacacaatctccccgatcatacgcatcatcctgactatcgtgtgtacctgtggaagatttctgcagcttgtccccatttccttccagatataaggaactgcatcgatccgcagaatgtcaatcccctgattgaccaggaaaaggaaattatacatcatttcgttaaacaccctcggattcttataattcagatcccactggtaaggataaaaggtagtcaacacgtagtgtccgatttcaggaagccaggtgaaattccccggtgcagtttccggaaatacctgtggcactgttttctcatattctctgacatagttttcattgtcacagaaaaaataccggctcatatattcgccttcacccattcttgccttctgtgcccattcatgatcttcggaagtatggttcattacaaaatccatacacagattcatgtctttttcatggcaggcttcagccagatctgcaaggtcttctatggttccaagttccggctttacttttctgaaatccgcaaccgcatagcctccatcggatcttccctttggcgaatcgagaaacggcatcagatgaacacagtttacaccacattcttccagatacttaagctttcctttgactcctcttaaatttccggcgaaattatcaatatacagcatcattcccagcatgttttttttacgataccacgcctgatccttttccttctccagatctctctttcgaagtttcgcatttcttgcatgatagtaattctgcatctgttcacagagttctgcaaacattgcttcattatcatataattccatatagagccagcgaagctcatccatatgcttcgccagtctcttttcaaaaatatcatttgtttttctcatttttactcgaccatttccagataaatctgatatgctttgtactcaccaaattcaagcggcatcggaattccaacttccatcagcgcctctgccggataaatttttccagtatttgaatctttatagaattgtccggcacacagacctttcatttttacataatttactgtcatgtttccatggatttcaagcataactacatttacaagtacttctttcccatcttctgatgcaaattcccatgcaccgatttcttctgcgaatggattactcagtcgatagtaaagtccattttgtacaagctgtgcatattttttgtattctactatctgttccctgatctctctgcgctcttcatctgtcattttcgccggatccaattcatagccgaaggttcctgccatggcacagacacctcttgtatggagtgatgtctttcttcctgtctgatgattcggaactgcagatacgtgagatccaactgcagataccggatacccaaaggatgttccgtattggatccttacacgatccactgcatcggtattgtcactgcaccagatctgtggtgtataatacagcattcccgcgtcaaaacgacctccaccaccactgcagccttcgatcagaaggtctggatagcggcttataatacgctccaggaaatcataaagtccaagcatgtagtcatactgcacactgccctgttcttctgctgtcatagaatatacttctgccatacttcggttcatatcccattttacatattcgatatttccctgatcgagcacctgacacatctgctcataaacagcatccacaacttcttttctcgaaaaatcaaggagcagctggtttcttccttttaccggttttcttcccggaatctgaattgcccagtccggatgttcacggtaaagatcactgtcttcatttaccatctccggctcaaaccagagcccgaatttaacacctaacgcattgatcctgctgatcaggtcaccaagacttccctgcagctttttttcattaaccttccagtcgccaagtccactgttgtcatcatttcgacttccaaaccatccatcgtccagtacaaccatatcgattcccagatcctttgcctgctcggcaagatgatagatatcttctcccgtaaaatcaaaatagcatgcttcccaactgttgatcagtaccggtcttactttttctttatattttccgcgacacagatttttacggatacatctctgcagattctgggaaagcttttcaagtccctgattgctgcaagttaaaataacttcagggatcacaaattcctctccttttttcagtggataaaaaaactgttcttcctgcagtcccatctgcattcttgtctgcccgaactgatccttttctacttctgctttaaatcctccgctgtatacaaaagacattccataacagataccggcatcttctgtcgtttctttttctgccagtatcagcatcggattgtactgatggctggatgttcctctgcggcttccaattacaaaagctccatgtcctaccgatgttctttgcatatttctttccatcgcatggcggccgtaaaatgaaatcacatcaaactcaccgtgaaggaaatcaatacaggctgcctgtgcttttgtcagtctgattttatcttcttctgtattgatcacttttgcacttcttgtgatcacatcatactccggaagaactccataaagtaattctacctgtaatcctgtcacctgatctttcatataaatgatcagagtctgggcttcctcttcagcagcataaactgccggaagtcccttcaaattgtattttccatcacaaatctcatatccctgatatctaagatcgcatccaaaagaaccatctgcatttacaagatcaagcaccggactcctgaaatctcctgtcaggcggcatggaaattcctgcggcagcacatcaagggaatatgttctgtcatttcctgtatcctgcggatttcctgagaagccacggtctgcataggtcagaagatagtccataactccatctgtctttcttccataatataaatgcagtaaaaatccatatgcatcaatttgcatctgatacgttgtattttgggtatgtaatgtaaatgtttttgctttctcgttgtatatgattcccatattcttctccttaagcttctgtcaaatttattttactgcgccatttacaacaccgttcagaatctgtttctgacagatcagatagaaaatcaaaatcggaagcagtgccagtaaataggatgcaaatgcaagattataattggttccaaattgtgtctggaatgtcatctgtgcaagtggcagtgtgttcacatcactacctgccagaattacaagtggtgtcataacatcattccatgtaccaagtgctgtaagtaccgctactgttgcatgcatcggtttcatgattgggaaaataacgctccagtaagttttccaggttgttgccccgtctacatgtgcagcctcttccagtgccatcggaatatttttcagataaccggagtataagagcacattcatcggcatataaaatacaagataacacaaaataacaccgaaaatattgtcaattctcatctgtgctgtctgcttcacaagtggcatcatcaaaattgcaaatggaacaaacataccgcttacaatataaagataggctactttgtaaaatttactggtacttttacttcttccgatcacataaccgatcatagaatgaatcagaatggaaagaactaccgttacaatcgttatcagcacactgttgcccagtgaatgccagaaatctgttacacgcattgcttctgcaaagttagaaaagctccagctttttggcagtgataagattccggaaatactgtttgtcatttccgacggtttcttaaatgcaatcacaactgtaagataaagaggaaaaataacggttacaagacccagaatcaataaaattgtgattggccagtttactctttctttcacctttactttcattataactgttcctccttatttcccaaaaagttcatctgtaatacagagatcacaacgatcactacaaagaacacaactgcattggcactctggaacccaaactgtcctccggccataccattgttataaatcaaaaatgaaattgattctgtactctgcgccggacctcctttggtaagagccatgatctgatcaaataccatcagaaaattcttcatgcaaagtaccatattgatggtaaagaatggaaggatcagtggaaatgtcagattcttgaattttttccatccggtcgctccatcaagagaacctgcttcgtatacatcctccggtaccgtctgaagtccggaaatataaataatcgtattcattgcaacagactgccatgcacatacaattacgatcgcaacccatgcccattttgagcttgccaggatactgtcaccttttccgcccatcatttttacaactgccggaagaatataagtgaaaaagtaattgaaaatatagcccactacaagtgctcctaaaatatttggaacgaaatacattcctctgagtgcacttttaaatttaattttactgtttaatccaagagctaaaacaagacttaacacatttacaactattgttgcaacaattgcaagcttgaatgtaaacaggtaggatttcccaactcttgcatcagtaaataagtctgtataatttcgaatacctacccagtcaaactcgccatatcctcgaaaatttgtaaaactataaataacacctttaataagtggcagcgtattaaagcagaaaaacaacgcaagtatcggtatcgtaatcagtaaaaatgtccgctctctgccattcatccttttcaatttattcatgatctgtatccctcctacttgcctgcttcataatcttccatcatacgaatgatatccctgttatatctgatccagtctttgtcaaattttttcaggaatgcgtcaacatcctggtttatgagaaatgtctggatttgtgcatcgactgccatttctgacggataatagtgatcctggtaatccgccatacggttatcctgaatatatggtttcatatcttccagttccggagctaatgcaaaatcttcgtctttacaaggcaccgcattctgtgcatctaagtatgactggatactatcatgatccatcaggaaatcaagtacttcatatgccgcttctttatttttacatgcatccatcacgcagaactgcagatctactcctgaatttaatacattgtcctcttccgaatcattagccggcataacaaaggatccgatattcatatccggatttacagatttgatctgcggaattgcatagcttccgattgtatacatcgctgattcaccatttgcaaatgcagtacatgcatcgttgtatccgtatccaaacggtccatcttcaccataatttaacaattcaagcattttttctgccacgtgcggatattctttggagaaggttgtttctcccttattcacctgctgacaaacatcggatggtgcaagtccgactgcaagtgcattccaaggtgcaaggcaggtccaggtatctttatatccaaaataaagtggctggattccttcattctgaatctcctcgcaaagagaaataaattcatcccaggtctgcggaatctcccatccatgttccgcaaacatatctttgttatagagcactcctgccgcatttgccacatacggaagcccatatgttccttctgtcggaacaaactccaatccttcaataatatccagataagcaggtttcacctcactaagtccttcataatctgaaaggtcagccagtattcctgaatcaacaaaatacgaataattgatatctcctccgattccgataatatccggataatcttctctgataaaacgtgttttcaaaattgttgtcgcatcatttggggaagatatttttaaatggatatcatcatgtgtctcattaaattctttttcgagctgttcaaatatatctaccgcctccggtttatactgaacaagttcaatttccacttttccgctttttgaattttgctgacatccctgtaatactgctgatgccatcagaatacaggacattcccaaaacaattgctgctcttttccttctcattttttctccttcctcacaggtatattcgtttttagttaccgctcgatatatcaagtactttctttatagttgtattataacataccattatgcgactaaaaatatcattgtatttgaatttttattccaaaatgctattattttcttcttttttgctaaaggtatagcattttggtatattttagttgcaatctatttattaaatcagtagaataaatatatatatcaactgacttaacatctgctaaacatcattttttcacggcagagcacctatgagaaaggaattattatgaaagaacttatgttttcagtatttccaagcgagaattttgtcgatcttggattgtatcagtttggttacgaacaatgtgaaccggcgcatagttttggtcctgccgtccgtaatcattttctttttcactacattatctccggcaccggaattttaatggcaaatgattctcacggtgtaacacagacctatcacgtaaaaagtggccagggcttcatgattttccccggtcagatcaatacttatatctctgatgaaaaactcccatgggaatatacatggattgaatttgacggactacgtgcaaaggaaaccattgaactttccggacttagtttggataatccgatttataaagctacttctaaggatctgcgtgaaatactgaaagaagaacttctctatattgcaagtcacggagacgctacaccatttcacctgatcgggcatctctatcttgcaattgatgctcttattcgttcttcttccatcatgcagacatcgaaaatcagccgtcttcaggatttttatatccatgaagccctatcttatatagagcagaatttccaaaacgatatttctgtcgaaaacatcgctgctgtatgcggattaaaccgcagttatttcggaaaaattttcaaagacggaattggaaaatctcctcaggaatttttgttgaattatagaatgattaaagctgctgaattattaaaactgacaaagctttccattaaagatgtaggtaatgcagtcggttatcccaaccaattacatttttccagagcatttaaaaatatttatggaatatcgccaagagactggcgtaatcagaacagacttaaacaataatagaaaaagaatgctgcagttcagactgtgcattctatttttattatttaatatgtaataataaagaatgtgcctgggctcgtagtgccttttatttaacaggaagttcctacggattttgctatgcaataaaaaaactgcaaacccttacggtctacagctcccttactttctacatgtaccttcaaaaccacatacaaatttaaatctttactccatccattcttccttaccctgtcctaccttcttggttatgccctcgaccgattagtaacagtcagctccatgcattactgcacttccacctctgccctatctaccttgtcgtcttcaaggggtcttacaacttgcgttgggatatctcatcttgaggggggcttcacgcttagatgccttcagcgtttatcccttcctgacttggctactctgccatgctcctggcggaacaacagatacaccagcggtcagtccagcccggtcctctcgtactaaggccagctcctctcaaatatcctacgcccacgccggatagggaccgaactgtctcacgacgttctgaacccagctcgcgtaccgctttaatgggcgaacagcccaacccttgggacctacttcagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcagtgtcgcagtcaagctcccttctgcctttgcactcttcgaatggtttccaaccattctgagggaacctttgagcgcctccgataccctttcggaggcgaccgccccagtcaaactccccacctgacattgtcccccagccgggtcacggctgctggttagaaatccaatactgcaagggtggtatcccaacagcggctccgcatcaactggcgtcaatgcttcttcgcctcccacctatcctgtacatacaatatcgaatcccagtatcaagctggagtaaagctccatggggtctttccgtcctggcgcaggtaaccagcatcttcactggtatttcaatttcaccgggtgcattgttgagacagtgcccaaatcattacgcctttcgtgcgggtcggaacttacccgacaaggaatttcgctaccttaggaccgttatagttacggccgccgtttactggggcttaagttcaaagcttcgcttgcgctaacctctccccttaaccttccagcaccgggcaggcgtcagcccatatacttcaccttacggttttgcatagacctgtgtttttgctaaacagttgcttgggccaattctctgcggccagctctcactggcactccttctcccgaagttacggagtcattttgccgagttccttaacaatgcttctcccgtcggccttaggattctctcctcacctacctgtgtcggtttacggtacgggtacagtacaaacaatagcggcttttcttggcagctggctcacacatttccctacttttgttcggtatgcatcacgtcttcggattgtcacgcggatttgccagcgcgactcctacctcgcttgccgcgggattccattcccgctagtgctctccctctgcgtccccacagttctgttatactgcagtacaggaatttcaacctgttgtccatcggctacgtctttcgacctcaccttaggccccgacttacccagagcagatcagctttactctggaaaccttgggtattcggccggaaggattctcaccttcctctcgctactcattccggcattctctcttcttaaaagtccacagctccttccggtactgcttcttccctttaagaatgctcctctaccaattaactacgttaattcctgagcttcggtagtgtgtttcagccccggacattttcggcgcaggacctctcgaccagtgagctattacgcactcttttaatgtatggctgcttctaagccaacatcctggttgtctttgaaatcccacatccttttccacttaacacacattttgggaccttagctgcaggtctgggctctttcccttttgactgcccaacttatctcgtgcagtctgactcccatgaatcatcttactggcattcggagtttgatatcctttggtaagctttgacgcccccgcgggaattcagtgctctacctccaaaagactctcatgaggctagccctaaagctatttcgaggagaaccagctatctccgggttcgattggaatttctcccctatccacacctcatccccacccttttcaacggatgtgggttcggacctccattgccttttacggcaacttcatcctggacatggatagatcacccggtttcgggtctactccatctgacttaacgccctattaagacttgttttcacttcggctccattccttaagaacttaacctcgccagatggcgtaactcgccggaccgttctacaaaaagtacgcggttcatcatatatagatgttccacagcttgtaaacacagggtttcaggttctctttcactcccctcccggggtccttttcacctttccttcacagtactatgcgctatcggtcactaaggagtatttagccttacggggtggtccccgctcattcccacaaggtttctcgtgtctcgtggtactctggatcccgccttgctgactcgtctttcgcttacggggctttcaccctctctggctggctttcccaaaaccattctgctaaacttatcagatcaattacgcggtccgaaccccggaatgcacgcattccggtttgggctcttccgttttcgctcgccgctactcacagaatcacttgttgttttctcttcctccggctacttagatgtttcagttcaccgggttcccttccatacgttatggattggcgtatggatgactggagtctgtccagccgggtttccccattcagatatctccggatcattggatatttgctcctccccgaagtttttcgcagcttatcacgtctttcatcggctcttagtgccaaggcatccaccctgcgctctttctagcataaccaactcccttctcccacgggaatgggatccggttacacatgcatagcgttgcatgcgttggtatttcaggtcgtttttttacttcgttttctcgaagatgtaagttaatcattaccttgcggtgatgatcacctcggatgtctttctctatttgagaattgatttatttttgtatgcagttttcaatgtacatgtctgactgatgtttatcagtcatcagaaaccaaaatcctttttaatctctgatcactggtaaagatcaattcatttcttttttcatattaaactttttataatctggcggccacctgctctcccacaccgtctccagtgcagtaccatcggccgatcaggtcttaaccatcgtgttcgggatgggaacgggtgtgtcccctgaccgcatcgccaccagaaatatctgagttttgataactcaacaatagacaacgaactttccttacttcttcttccttagaaaggaggtgatccagccgcaccttccgatacggctaccttgttacgacttcaccccagttatcggtcccaccttcggcagctccctccttacggttgggtcactgacttcgggcgttaccaactcccatggtgtgacgggcggtgtgtacaagacccgggaacgtattcaccgcgacatgctgattcgcgattactagcgattccagcttcatgtagtcgagttgcagactacaatccgaactgagacgttatttttgagatttgcttaccctcgcaggcttgcttccctttgtttacgccattgtagcacgtgtgtagccctgctcataaggggcatgatgatttgacgtcatccccaccttcctccaggttatccctggcagtctctccagagtgcccatccaaaatgctggctactgaagataagggttgcgctcgttgcgggacttaacccaacatctcacgacacgagctgacgacaaccatgcaccacctgtcaccggtgttccgaagaaaaggcatcattacatgccggtcaccgggatgtcaagagcaggtaaggttcttcgcgttgcttcgaattaaaccacatgctccaccgcttgtgcgggtccccgtcaattcctttgagtttcattcttgcgaacgtactccccaggtggactacttattgcgtttgctgcggcaccgaagagctttgctccccgacacctagtagtcatcgtttacggcgtggactaccagggtatctaatcctgtttgctccccacgctttcgagcctcaacgtcagtcatcgtccagtaagccgccttcgccactggtgttcctcccaatatctacgcatttcaccgctacactgggaattccacttacctctccgacactctagctgcatagtttccaaagcagtcccggggttgagccccgggctttcacttcagacttacacagccgtctacgctccctttacacccagtaaatccggataacgcttgcaccatacgtattaccgcggctgctggcacgtatttagccggtgcttcttagtcaggtaccgtcattttcttccctgctgatagagctttacataccgaaatacttcttcgctcacgcggcgtcgctgcatcagggttccccccattgtgcaatattccccactgctgcctcccgtaggagtttgggccgtgtctcagtcccaatgtggccggtcaccctctcaggtcggctactgatcgttggcttggtaggccgttaccccaccaactacctaatcagacgcgggtccatctcataccaccggagtttttcccactgagccatgcggctccgtggtcttatgcggtattagcagtcatttctaactgttatccccctgtatgaggcaagttacccacgcgttactcacccgtccgccactcagtcacaaacctcttcatccgaagaatcaaagataagtgcttcgttcgacttgcatgtgttaagcacgccgccagcgttcatcctgagccaggatcaaactctcgttaaaaatgtttgtatccgggtcagaatcgcttggcaattctgttcctgtttactgttctggttcgacatctttcgatgtccgttcttgaaaaatctctttaaagaattttcagggtttgttgtctattgttcagttatcaatgttcttttttgttgttgccgtttcatgcgacagcttttatattatatcaaagtgtttcatgtttgtcaacaacttttttatttcttttttgctgttgtgaagcaatccctcacgcgacagctttaatagaataacatattcatcaaggcttgtcaacagcttttttatttttcatccgctctgcctctgcatgccacaccttagtctctgtctcgactagcgaacatatggtatcttaccacggctttcctgaattgtcaatgttgtttttatattttgcgcaattcagaatattctgacatcagttcagccatccgtatagtcagacggatttcatgctcgcatgaaaggacggctgattatacaattatacatatatggatgagatgagcgccactctatgagcaaaatagctgcgcagcagcgacaagtgccgcaggcacgcttttgcgaatggcgcggctgaacctcccttattccatttcagaatatagcctcagcaatcgttctccaacttttccaagacttttattacaagcaattttccgttcttcctttttcatcaaacgaacatcccgactgaaaatcgcagttatcttttcctgaaactcttttattgtctctgctttatatacctgtttttcatcttcaagccatccttcatacacaggaatgtttcttactattgtcggaatttcacaggcaagagcttctaaaacaacgattccttccgtttcctcataactcataaacgaaaatacgtctgccccacaatatgcatcacgcagttcatcagactttacgaatcctgcaaacaatacattatccggtttctttgatatcgcctctttgatttctgctgtcaccaggctttcattaccgcctccaaaccagataaactgtactttcggcatcattctggccagttcaagaaaatccagaattccttttctttcaatcaaatgtcccacagatatcacaaccttctgctcttccgttagctgatattttgcgcggaagcgtattctcccctctggatcaggtttgaaaaattctgtatccacaccattagtaatcgaataaatttttcgtttcaatccatacccttccaacaattttctggaatactcggttggcgtcacaacaacatcccccaaattataacaaaagcagatccattttttaaaaatcggcgctgcaagattagaaccaataaaggaatttttaaaatcttccattgtagaatgcccataataaatcacttttttcttctgcatttttgctataaaggccgcaatcaccgaatctggaaaaactgtattcatatgaaccacggttgcttctttccacctggctgcacgcggtgcctctactgcattcagcattttctcctgatgctcgattgcttttccgacaccacttttttctacaatcggaaacccacctctgtatatatatgttttcataatctttaccctattccttttataatgaaaataacatcttaaatgctgtcgtaagccccagactgtaaagtgcaatagaaaatggttttccaagtacaataactgctgtaaactgtttccacgtcatttttgtagttcccgcaagatagcacaagaaatcatccggtgccaccgggaaaaagattgccagcgcaaataatttcaaaaacttaccgtccttctgggtccatccatcatatttttctatcattttttcagaaaacattttatataaaaccggccttcctattgtctttgaaattccaaacactgcaattgatcctatacagataccaatataattataaagaaatcctagccacggcccaaaaaagatcacaccacccaggcaactgactccacccggtagaattggaataataacctgcacaacctggatcagaataaaaacgagcattccagtataaccgaatttccagataaatgtctgcaaagaatctaccgaatttaaaatgccgtttttatatgcccagattgcaagaagcgcacatccggccagtccggctatcgaaagcagattgaaaaatccagtcagatttctctgtttcttaggctgcattttcatatcggtattttcgtatttgctgttcatagattttttccactctttcggcaaaatttccggaagaaaatttttctgctgaaatagcagccttgttttgcatcctgcctcttgcattttcacccatccccttccattcttggattctcataagataatcttcttttttatcatactgccatccattttccccatctgtcacaacttgttccagacatccgtctcttctgcaaaggagcggaataccacctgcaagcgcttctgcataagtcattccctgtgtctcgctggtagaagcacttacaaatagatctcctgcctgataatagcgtcccacttcttccggtatgatcattcccgtaaaaatcacatttttagcaagctttagctcttcgaccttttttttcagctccggaagatatggtccatcccctacaaggactaaaatcaccccggattttcctgcatcttgctgatattccagaagctcttcaatgtttttttcctttgccattctgcctacatataccaacaccagtgcatcctgtgatataccaagctgcatacggatttttttacgccagtcttcttttttacataactgatatttttccagatggaataacttccaccggacaagacacctggtatccttccaatatcttacggatcttatcactgggtgcaattagggtttctaccacatttgcaagtttctttgtcatcaactgcacaatatttcttccccatactttctgcggtgaaaaataatgggtatagtcctcgtaaactgtatggtacgtatgtacaatcggaacgtgaagttcagatgcgatccttttcgctaagaaaaatgtggaaaattcacactgtgaatgcacaatatccggtttccactcaagcaacatttccatatagtcacctgctgcctttggaatttttaatcttgcctgcggataaatgcatccaagtccaattgatcctgcataaaccacatcgccttctatataagaatgaaatgttcttgataatgtaagaatttttacttcatgtcccctttctcttagctgtctggaaagattcataactgaagtaacaacaccgtttataaccggttcgtaccagtctgttgtaatcaatactctcatttattagttcctcccgttatctttttatgagcatagtttaacaggagattgttaagatatggaaagggcatttctaaagaatttttaaacaaatgcgaaatattcagtcaagacaatatttcaaaaaaagtgtatcactttttagaactctctaaaaaatgatacactttctatttactcacttaatacatccaatgcactcattgccaagagctgaacagaagcatgcagatttctttttccttcttctccgcctgctgctactgcaaactcttttgtatgtgttcctacatgctctttcaatttcacataaaactgaattgccggtatttcatgggttacatttccaacatcagtcgaaccgattccctgagtcaggtcacgctctatatactcttcaccaataaagtccatgttcttacgaacatactgaaccagtttcttatcattacgcacatctttgacaacttcatccacttgtctttcttcaacttctgtcctggttgcaattgccgctcctttcgcacaatcacgaatagcatcaaccatttccatcatataatcatattccagtgaacgaatattaaatactgctttcgcttcatctgttatagtattatgagctactccgccttctgtaataattccgtgtactctgctgtaatctttaaaatgtaaacgcatcatatcaaccgcatggaacattaactgaactccactcagtgcatttgctcccttccatgggcaagctgccgcatgggccggttttcctttgaaggtgaattccaatgtaattgctgcaaaagaaatatcatctggcatagattcatcacacggatgcatcagaagtgcagcatcaattccttcaaatactccatggcgaaccataatcgctttgccactgcccttttcttcggccggagtacctaatacttttaacacgccacctatctcatgcttttccataacttcctttaatacaattcctgcaccggctgctgatgttccgatcagattatgtccacaaccatgtccgatttctggaagacaatcatattctcccataagtgctactgttttccctggttttccagaatcaaaaactgcttcaaaagacgtcggcatttctgcaattcctcgtttaacaacaaagccatggctttccaacagtttgcaaagtgcttcctgtgatttatattctttaaatgccagttcagggtttgcaaaaatataatcacttactttttcaaattcttcctttttctcttttgcaagattactgatttcctgtttcattaattctaaattatccatattcttcacctcttaattttatctgtatggttttagatcattccttttaaagataagataatatttgaaattgctgctgatccaaaataagtagatgccataaccacaaaggatacaattacgattttccagctgagttttttgaaaacctcaagctggtctcctacagcaattccagcaaaagcaagtagcggaagtcctacaagtccaaaactatatgcactcattgcatttacgataaaatctgaaatcggagatatcggcaatgtcaaaacaaaggataccagtgtagcccacgcaaatcctggaagattaggttttttcacaacatttttcaaggtaatcgcaatcactaccattacaaagcttaccactgtcgactttgccaaatccggaagtttgcttccaatagaaaccatatgtataattatgacaattccataaatcaccaatactattttaatttgttctaaaatatcacttaatgtcgatttttcttgtggagtttgttttgtattttccatcttatgcctcctcagatgcttttttaaataatttagcccttaatttttcaatacctggattaacacgattataataccagttcgctaatggcaatgccaaaaacatttccacatacacacctgttactgcagttaaaagtccactggttgcagaatatgcaagaatttgttctgcatacataggtgccgctgcatttgtcaacgctgcagtagccgcattcatcatagatgcacttcccatacctgatgccatcgcaagtgcataaggatgaaatccgattgctaacccgatcggtgccaggaaagaatagaagagagtaccaaatacacttccgctaatataagttccaagtgttcccattccttctctggattccagaccatatttatctccgataataccaagtgccgtatctctgcaaagagaaaacgttccacccacagcacttcttcctaatccaaggagtaagccaagtggtaatgcaatcagcatcgtcatcatatttcccgcttcctgaaacagtaaagcaggacctgcctgtaaaacaattccaacctttggacctgcattgataccaaacataattccaagcggatataatgtaagcgacaacaaaaacggtgcccgtttaatttctgcgttactaataaatttcttcagtgggggaatcacttttcctaataatgttggagataaaagaattcccatgatgataacccaaatcatcgtcaatatcttcacgtcaatccccatcaccttaaattgaagtggaccaatcagctccgcaataatgcaaataataatagttgcgatcatgcaatttacagtccctgttctttctttcacattttattcctccgtttcttccgaattcttatttgactacagtataacattgacttcttaaagtgtcgacgctctccatgcaccataatgtccctgttttttatgcactttgcacatttattattcttccaaaaatatagcatgtgcatttcgcccaactattttctttctttttaggcacgcacaatatcgactttcctatttagtaatgctaaactttgcttgtcaattaaaaaactattttagttagaaagagaggatttaagatgttattcaaacaattaatagaagctttcgacattatagacagtaagaacgtaaacggcaactctgtcgcatcttatttaaaatccataaaacaagatgcggatattcaggtttatcctttagttgggccaaaaggttctacagatatgttaaaaattcgcatcccgggtcttcacggaaagacttccggaggcgatgctccgacaattggacttcttgggagattaggcggacttggtgctcgtcctgagcgaatcgggtatgtatctgacggtgatggtgccctcgttgcaattgctcttgctgccaaattattagatatgcagaataaaggggattttttggaaggtgacgtattcatttctacacatatttgtccggatgcaccgaccgcgccacatgttccggttccatttatgggatcacctgtagaaatggcacaggtaaatgccgaagagctcacaccggaacttgacgcagttctctctgtagatactactaaaggaaatcgcgtgatcaatcacaatggatttgcaatctcacctacagtaaaagaaggctacatccttcgtacttccgaagatcttcttgatttaatgcagattactacgggaaaacttccaaaggtatttccattaacacagcaggatatcactccttatggcaatgatcttcatcatctaaacagtattctgcaaccggcaactgctactaatgcacctgtagtcgggattgccatcacaacagaaacaactgttcccggttgtgcaaccggagccagtcatatgactgatcttgatgaagctgcacgctttatgttagaagttgccaaatcctttggccgtcgttctcttaaattatacgacgaagaagaattcgaaaaattacaaagtttatacggttcaatgaagcatttccaaaaactgaatcctttctcgtaagagatacatactgttttgaaataaaagatgccctgaaaaggcatcttttatttcaaaaatttctttattcgaagcgcaagcgctatctcaagaatactattcggatctgacaaatcatatcctgtctgattttcaatttttttaattctgtatatcaaagtatttcgatgcaaatgaagtgcatttgctgttacatttcttgcccctaaattattcacgagaacttccagcgtttctaaaagttcactttcatttttttgatcatattcaataaatgcattcaacttgtcctccataaactcctgacacatctcatgcttactgatttctttcatgattctccaaaagcctgcatcttctatacaaagtacttttgaattgaactcctggcacactgcaatttctactgcatcccttgcatcctgataagcctttccgaaacgttggtaggaattttctactctcgaaacacctatcgctgcagtatatcctgtcttttccgaaatatttttctgaatcttctcgaaatactctttcgttatagttttctcttttgtccgttttaatatgcattgaaaattatcattattcgacaaaacaattactttttcctcgccaaaagattcttttatcatattttcgattttctcaattttttcatgaacaatctcttcctgtagttcatgtaatttttgtttaattccatcaatttcaatataaacgatctggtacggaggtgatggccatttttgttcttcgatccgatagtttccttcttcattacatgtgatatttcctgtcaaaagatcaataaacaatcttttatccatttcccgacggttatatttttcaattcgagaataaatgctatccatcaaattgttctgtgattttatcaatgcctccatcacaagataattcatttctatgaaaggcaaatcttccggccacaaaatgattgggaactgtaattcattagccagtttgatcgcatcatccaaaaaacaaccaatatatctatattttgtcgcgagcgcagctgcctttgcttcatacaaatttcttatcagattcattatttcttcttttgtgtcactatatgcatatccagttgtaatatacaaaacatttgggcgcatccatgctttcatatctggtatttccatacaatccacaaagcgaacaatcctatccattccaccttctccggctgctaatgtacatcctttcgactgtgccagctctaatacctcttttacttttattgacactttctattccacccttttttatttgtattatagataaatatagaatatcataaaacactgttttttcaaatatcatcttacgcttaactttatccagattgtatttctgaccgaacgtcattttttctcatggattttttccacactttttgctatactattctcaatactggcactattaacgacattacacaggaggttcacatgaagaaagtgcttcaaatatttcagagagatttaaaaagactcttacgtagccctgctgctactctcgtcatggtgggagtctgcattctcccttctctctatgcatggttcaacattgccgccaacatggatccctacggcaatacaaaaaatgtaaaagtggcaattgcaaattgtgacaccggtggacacaccggttcgatgaatctaaatgccggaggcaccatcgtacagaatctgaaaaaaaatcaccagcttggctggacctttgttgatgaaaagaaagccaaaagcggtgtccgttccggcaaatactacgctgccattgtaatcccggaggatttcagcgagtctctcctcagcatcctttccggggatttaaaacagccgcagctcgactattatattaatgaaaagaaaaacgcgattgctccgaagatcaccgccaccggcgcaagcacgatccagcaacagatcaatgacaccttttcgtccgttgccgctgactccattgcgaagatcgtgcagaaatcggccggtacactgaccggcaagcttgacggaacaaattctacgctgatgcaggcgcttaccgatacccgtaagaatcttgctgactatcagaacgccctgaaggatttccagactacggtaaaagattccggttctttgatcgatgacactctgaaaacactggactctgtaaatgctgttgcctcttccggttctgctgcccttgcagattcatcagatctgcttgccaccagccgaacagcaatcggaaccttttccacagaattttctaccagcctgtcagatggcgagacgcttttaaacaatgtctacacctccgcagccttaaagctcggaacttttgagacaaaagccacacaggtcaacactgcgatcggagacagtatttcttctgccagctctttaaataagaaaaatgcagaaattctggaaaagcttgccgcccttcagcagcagatcggaagtgattcttctctgtccggtatcgtcagcgaaaaaattgcagaactccaggcacagaatgcttctcttcaggaactcattgattctcttgggaacagcaattccagcataggaaatgcactgactacagcaagtaataccagaagttctcttgagacactcactgcccagaaccgacagtctctgcagaattacagaagcagtctgaaccagtcgcttctgccacagctgaaccagtcacttgacgggcttgccacattaagcggaagcctttcttctactttaaccggggtaaatccgacgatcacacagttaaaggtgatccttacccagttaaagagcagtttaaacgaaagtgcagacgcacttggtcagaccggaggaactcttgaaagcgtagatactgctctggaaaatattaccgctgacctaaaagctctgcagagctccgaaacctaccagcatctgatctcactggaaggcatcgactcagattccatttctgattttatgtcctcaccggtttcgatcaattcaaaggtactttatgatgtggaaaattacggttccggaatgactccgttctacactaatctggcactctgggttggcggactgatcctggtatccatcctgaaacaggaagtagacaaagacgaaaccatttcccgttttactccgacaactgcttatttcggacgttggatgctctttgtcgtggtcggactgatccagggatttattgtgtgcataggagatctgctgcttctgaaagtacagtgtgtccacccggttgcatttgtgtgcgctggtatgctctgctcctttgtgtatgtcaatctgatctatgcaatggcgctgaccttcaagcacattggaaaagcgcttgccgttgtcctggtcatcctgcagatccctggttcttccggaacctatccgatcgagatgacaccggtctttttccagagactgcatccgcttctgccgttctcttacggaattggcgctatgcgtgagtgtattgccggattttacaaaaataactacgcaaaggatctgctgaccctgctgcttttccttctccttgcattcttcatcggactggtactgagaccacttctgatgaatctgaaccatctgttcgacaaacgtcttgccgagacagacctgatgctgggagagactgcaaccggtgagctctcccgcccacagcttacactgatgatgaaaaccatgatgcaggacgaagacggacgggctgattttatccaacgtgccaaccggttcgaaaaacggtatccaaagctgatccgtaccggttttatcctgattcttgtaattccgctgatctttcttcttctgatgttcggcctggaatccaagatcgtatacctgacactgtggatcatttccctgatcgtactcgccgtctatctgatctgtgtagaatatattcacgacaagacctccagacagctttcctatatccatctgtctgaagaagaatttcttaaaaaagtaaaggagggaaaagacgaatgagaaatatgtggaccatcttcacaagagatatccagaaaataagaacaaatgtcattgcgctgatcgtcgttctcggcgtcacagtggttccctgcctttatgcatggttcaacattgcggcaagctgggatccctatgggaatactgggaatctgaaggttgccgtagcaagcgtagatgaaggctataccggaaacctgatcccgctccagctgaatcttggcgatcaggtattgtctgctcttcgggagaatacacagctcaactgggtatttacgaccaaaagcaaagcaatgaagggtgtaaaatccggagaatattacgcagcaatcgtaatcccggaagatttcagtacgaacctgatgagtgtattttccagtgatattaagaaacctaaaattacctattactccaatgcaaaagaaaatgccattgcgccgaaggtaacagacaaaggagcaaccgcagtccagacacaggtcaacgaagtatttatcgaaaccatttccgatacggtgctgaccgcgctccagactgttgcaaataccgcagactccagggattcggatgagcttgcaggcacactgatcacaaatctgaataaaatcggttctgatctgtctgcctcttcgactaccctgcattccttctcacagatgaccgattctgcgcagcagcttctggacacaactaccgaattcttaaaagcaacgaaagaacaggcttctgcaaatgcagatacgctttccggtgcacagcagtccttctccgggattcaggaaactctggacggagctacagacggaatcaatgctgcactgacctctaccaaaagcttttacgaacagatgtcacagacgatcgatcaggcattccagtcgcagtcacaggatgcttcttctgttgccagcacccttgatcttcttggaaaccgcgtcaatgcgatcgtacagtcttaccagggaatccgtgacagcattgcacagattgcagatgcacacccggagctgtctgatcttaccgcaccgattcttgctaaattagacgattccattgctgttcaggaagaacttcgtgataaactcacgaacgctgcttcctctctgcgggatacagcaggcaatgtaacaacctctaaaaaagagctggatgatctgatcagctccagtatttccggaattgcagctgtcaaatccgactatgaaaccaatgtatctgcttctttaaaacagctgtccgtctctcttggttccaccaaaaatgatctgtccggactgctctcccagctcggtgtaagtgcagatggaatctatacccttgcttcttcagctggctctgatctgtcgcagattcagaaggctctggaaacctcttctgagcttttgaaaacggctgcctcaaagatcacagataccatctccagacttggtcaaatggaagcaaccggcgatttctccgaactggaagatctgatttccggcgataaggacagtatcagttctttcctcgccgcaccggtagagcttaagaccaacaaagtgtacccgattgaaaattacggttcttccatggccccattctactctacactttccatctggatcggcggaattgtcctggttgccatgctcaaggtcactgtatccgaaaacggcacctccggacttaaacatctgaagctccatcagatttatcttggaagataccttatcttcctgatcctggggcttttgcagagcaccctgatctgcctcggtgatctgttctaccttagcatccagtgcaagcacccgttcctcttcctccttgccggatgggtatccagcatcgtatatgtcaacatcatttacacgctgactgtctccttcggagatatcggaaaagcggtcagtgtcgtacttctggttatgcaggtagccggaaccggcggaactttcccgatcgaggttgccccgggattcttcaaagcggtatatccgctactgccgtttacccacagtatggcagccctgcgtgaagctgtcggtggactgtatgctatggattactggatcgatcttggaaagctttgtatcttccttatggtgtccctgatcgtgggactggtgcttaggaagccgatcattaaggtgaatgaaacgttctctgagaagctggaagagacgaagattatgtaattttcaatattttttaccagaatacgttggattctaatttacgttcgaagcccccaataaaaggaacccgtcagcacgattttcaaatctgccgacgggcttcttgcaattatacgcttctctcttttgctacctgaacatatccagttttaccggcgttccatcatcataaaattcatacaacttttctccgtcctttacccgaaatccctttctgtccgttccgtccgaacaaggctgccatagttcctccggaatatctacataaataatcgttccttctgcctttgtacacgaaacatcatcaattgtaagctgaaattttgttccgtccgatttattctgcccccaacccaatgtacctgttcctttttcaaatacattatctctggactccatatcatcatttacaatatcaaataccatgcagaaatcctttttctggtgtaccttatagattccaagatgatacagatctccttctgactgatattcattatattctaaatgttcttctctaatgctgaaaaattccttccagttctctttcgtaaacttctctttctttatgtatgaacggaatttatcgcctgataattcataaaattctgtatttacaatttcattctcctgtatcgttaccggttcattgtcatcatcatatacttctatctcctttatacgatctttttcagacgccgtatcctttccaccacaggcaatggttcctgctacgatcaaaataattcccaaaaatatagcatattttctatattccaaatccactcagcaatacataataccctgtcaagatcactacaaacaccacaataaccgggatcgtcttcttcatcagctgcccccaggatacccggaaatattccgtaatgattgcaagacagatatgtgtcggtgaaatctgcattgccgcataagaaagtgccatcagatacaccagaagacctgctcctgcattcggtatgcttgcaaatgccagcggaatcagaagcacaatcatagaatttgctccactgataatcgttccaagaaacataatgattccaaatgccgcaaactgtggaattgcagatccgtcaaacaaatccggaagttttccgattgcccctgtataggtaagaatgttcttgaacatcatcagaatgatcgtattgaagatgattctccactctaccgatgtctttgcaaaatccagcacttccttcagacttaaccgatatacaataatcgaaagcacaataataaacggcagtaccttgatcacagaaagattcagtgcgatcacaagcacaatacaaagcaccagtggccagaaacagtacagaagctgtttgaattcttcttttttgtctatcatttcatcctcacttgcttcatatcctttcgaaagcttccgcagataaaatacatatcccagtaccagaagcaccacaaccatcggcgccataaaaagtacaaattgcccggttgataccgctgtaatggaaagtgccagcagaattgcattataagtcggcgaaaagctttctgaaatatggcggtagtaactggtcacaaacgtcttttcttccacatccagatcttttcctgtcgccttatctacgatcgccccacagatattgacagctcctgcagacggaaggaatccaatgatcaccggcgcaattacacacaccatacgcctgtctccgctaagcctctgtagtgccatctccgctctttccagaagtttccggttctccatgatccgctgcaaaaaggttacaagaataaagcttccgaccaccagcagcgtatccttttcataaaccgactgtatcatcaattttgctgcatccccaagcggaattccaaacaggatcacagtcagcaaaatggcagcgatcatcgcatcacgcagttttaattttgccaggaccatcaccataatgacaataaaaatcactgccagttttataaattcggtctgcatctctttactccaattctactacaatatatttatggttaatatcccttacagccagtaaggaattatccatcttgttgcttaagctgtataatgatggagcaatcggtatatcgtcttccaatcttggacttcgcgtccgtaaattagactgataaccagctcctcattcgcagcgttcgttttatgcaggttgaatcgccataggtgcattcgcgtcacaccacagtagattgaataggcaatgagtaaaactggtatttatccattgcaataatcttaaggagtgaccatttatgaacgcagtaggtatcgatgtttcaaaaggtaagagtatggttgctatcatgcgacctttcggtgaaattgtttccgcacctttcgaaatcaaacacacagccagtgatatccattcacttgtagaactcatcaactctgttgaaggggagtcccgaatcgtgatggagcacacaggacgttattatgaagtcctcgcccatcagctttcaaaggcaaatcttttcgtcagtgccattaacccaaaacttatcaaagactttgataatgattctcttcgtaaagtgaaatctgataaagcggatgctgttaagattgcccgatatgctcttgacaaatggcaaaatcttaaacagtataatgttatggatgaattacgcaatcagctcaaaaccatgaaccgtcagttcggcttttacatgaagcacaagacggctatgaaaaataatcttatcggcatccttgaccaaacctatcctggtgttaatacttactttgacagtcctgcacgcagtgatggcagccagaaatgggttgattttgcatctacatactggcatgtggactgtgtccgtaaaatgtctctgaatgcctttatcgaccattatcaaaactggtgcaaacgtaagaagtacaacttcagccaatccaaagctgaggaaatctatggaaaagcaaaggaacttgttcctgtacttccaaaggatgccattacaaagcttataattaagcaggctgtggatcagcttaacagtgcctctacaactgttgagtcactacgcactctcatgaatgaaactgcatccaaactccctgaatatcctgtcgttatggctatgaaaggtgttggaacttcactcggatctcagttgatggctgagatcggagatgtttcccgtttcactcacaaaagtgctattactgcatttgccggtgtagatcccggtgttaatgaatctggaagttatgaacaaaaaagtgttccaacctcaaaacgaggttcctctgatcttagaaagactttatttcaggtaatggatgtcctaattaaaacacatcctcaagatgatcctgtttatcagttcttagacaagaaacgtgctcaaggcaagccttactatgtctatatgactgcaggtgccaacaagtttctaagaatctactacggacgagtgaaagaatatctttcatctcttcctaaatcttaattatccactaatattttcagaccagcactggtgtggtggtcttattttgataccaaattttcaacctgtataaaattttcaatgttcttcaatttagccttgactttttatttgcaggcttttttttctaatttcccttttttcatccacagacaccggtccgcataatttgcaaattctctgtcgtgggtactgaccaggattgtcgttccttcttttgccattttttgaaaatatttcataatgatctctgaattttccatatccagactgcttgtcggttcatctgcgactaccagtttcgggttctgcgtaaatgtccttgcgatcgacacacgcctttgctctccgccggacagatttgccggatattcggaaagcatattctggattccaagaagctccgtcagatacgtgatcctttctttatccggtttccggtttttccccagcgaaagtgggagcaggatattttccatgaccgtcagattctggagaagattttgtccctgcatgatataaccaaggtcgcctccccgcagaaccgataactgtctgtcattcattttttcaatctcatgatccagtactgtgatctttccttctgtcggtttcaggatcccggtcagcatatggaagagggtggattttccacttcctgactgtcccatgatcgcaaccagttctttttcttccacttccagattcacgtggtctactgcgtaaaactgattctttccacgtacaaattcccgactcagattttctgtctttacaatcatgattccacctcctggatcagtttatatagttccatacgattcgctctgactgccgcatataaggtggcaagaaggctgacaccaaccgcaagccccaggctctgcaatgcaagaatcacatattgggaaacatttacattcagatatggcatattcatactttccatgatcacgtctttaaataacaggattccgcctccggagaacaccactccaagaaatcctccaagcacaccgatcattcctgcttccagaagaagcatctggaaaatctggctttttcgtgcaccaatagaaagtagtaccccaaactccttcaaacgttcattcacagtaatgttaaaaatgcagatcagtgccaggactgccattaaaaacaacagtccgatcagaagcgcgctgtaagactgcatctgttccagtgtatctgaaacttttccggacattgcttttgccgtataagctttcagtccggaatctctcatctttgtgttgatcgtgttcgccacttctttcggatctgctccgtctttcgtccggatcgtcagaagggaaacatatttctgcggttctgtaagatccgtcacatacttgatctgaaaactgtcaaataatgtatatgccgtctcaaaattcatgaatgcgcagttatcataactggttcctgtttcttcgagttttcctgcaacctcgtattcctgtccaaagaaagaaattttatctcccgcttttgccgtaatcttgcttccaacaacagtctgaccctttttcaattcactcacattgcttccagacatccacggctgtacaataaaatcactttccggttcaaaagcaacaatctgtaccggaactgaacagcatgccgcatccagtgatgcaatgtagagctgcggagaaattttgtcaattccatccgtctttttcacctgatccatcaaagacttttcaaaatagaaactgcacaaccctcccgaaaacagagaatcgcttaaatctgattcatattctcccggtgctacgatcacatccgccccaatccgatctactgtcttatcaatacaagttttcatactttctgtcaatactctactggtaaacagcgctgccgataaaatcagcaccagtgctgccagaaacatcgtcctgactcttcgatgccgcagatttctgactgcaagtccaggtacagtcaacattttctgttccatttttctttccttccttttttaacattttgttcggaaaacccccgtaattttccaattataagaaagaatgtgcctcggcacattctcgcgccgagcgcagtcgcttgcgacattcttcatcttcgtgcgagtgcgcaactccggcacgcagtgccttttgtttcataggaagttccttcagaatttcctatgaaacaaataaaaaatgtgcctcggcactttcctaatatacaagacaaaagaggagcttccactcatcccagagttcaaagctcctccacctcattcatttatgtgtctgattattttgtgcttactttttcagcaagtggatgccatgctgtctctacgactttatctacagtccagtcagaggtaatgattcctgccgcaatgtagtcctttgcaacagctttaattgtttcctttgtatctgcattggatactgcccagttctgctgatcaagcatgtattttgtaagctcgatgtcaccagataccataccctcatcaagcatgatctgtgcagcttcgtctttgttttctgcaatgtacatatatgcatccattacacattttgtaagtacctgagagattaccggattttcttttacgaattttccgctcatagccattacgcagcatgtttcatctttgaaatcatcatcccatgtgatagaacgaagaacttttaatgttccgtcatctacgaatttctttgcaaaacggtcactcagaaggcaagctttgatgtcacctgactgaagagactggattgctgcacttgattcaacctgtacacatgttgctgcatcctgtttcaatccatctgcaaggaagaaacggatgttcatgttgtgtgaagatccaccgatcgggctatccatgccaacagttgtgccttccaggtcttttgttgattcaattcctgaatcggcaagtacatataatgatttgcatcctgtctgcgcacttcctgtaaatacgatgtccattccgtttgtgatcggaactaacatatgtgcaatatggtgtactccaaactgagcttttccagttccaagtgcttctgtgatttcagtaccagctgcgatctgaacatctaatccccaattatcatagtatccgagtgcttttgccatgctaggtcctgatgtacagtcaccaccatcatattctgctgtgatggttgttccccatgccggctcttttttcattgcttctttaatttcatcatctgacatttttgtgatatcagtcacttctttctctgtagaagcttcctgttttttggaatcacttgtgtcttccttcttttctgatgagcttgatgaaccgccacatgcaaccagtgatacggtcattgcgcatgcaagtaacgttgcaaacaatctttttttcataattcttttctcctcttcgtgtttttactttgttgcttttatatttatctttcaataaatatccatttaataatctgtatgatgcttcagatcaagcatcttcagaatcctgttccgatatgcctgaaactcttcgctgtctctctgctttggttcagccagttcaatcggtatatctgcctttacacgtcccggtcttggctccataaccagcactcttgttcccatataaattgcttcttctacatcatgtgtaaccatgacaaccgtctgtttctgttctctccagatattcaggatctcatcctgcatattcattctggtaaatgcgtccagcgcgccaagaggctcgtccagaagcagaatatccggatgattgatcagcgatcttaccagcgccactctctgcgccatacctccggagagctgatgcggatagtcttttcggaaatcttcaagtcctaccattttcagcatatgctctaccagttctttatcctgctttttctgcatacgcaagctgaaggatacattcttctctaccgtaagccacggaaacaatgttgctttctggaataccattccacgatccggtccggctccaacaatcggtttcccgccaagtctgatctcaccggtagtcggtctgatcagtcctgcgatcaatcgcaaaatcgttgattttccacatccacttgttccaacaatactgacaaactcacccggctggatcgtcagattcacctctgccagcgcatgtgtgatctcgttactgtctgtctttgcaaaactctttgttactttgtcaaactccaggacacgcccgtgtccctgcttctcatccactgatgccatcttatttcacaactccttcctgccagcgaagcactattctcttgatcacattcagtataaaggtaactgctgtgaaaataagacaaattaaaacgatagctgcatacattttagaatagatcgcccatgatttctgccactggatataccatccaagacctgcctcggctcccatcatctcagcaaccagaagtgctgtacaggcagaactcattccctgtgtcatcccctgaagaatgtttggcattgcatgtgggattgccacccggaataccagctggtgccctttggcacctaatgttctggccgcttccagatatgccttgtctacattctggataccggttgacgatgcgatcgtaagtgcaaaccatacaccaagagcgatgataaatacacttcctttaaacagtgaggataccagaaccatgatgatcgggatccatgttgtggaagggatcggtccaagcatcttaatgatcggtgaaacccagtagttaatccttttgctgtatccacaggcaacacctgtgatcagtccaaggatcgctccgataaaatatcccgtgaataataatcgcagtgagtacaatgtacttttcaataacagtgcccggtcatcaatgatcgcacacaaaatcgtattcacacatgggaagaacggctgttttaaaatacctgtcttaaccgtcagaaaatcatacagcataattaccagtatgatcacagagtaaagcggtgctttatgacgtacttttgcaaaatagcttttattcagtaatcctctcactaccatgatcagatataatgccaaaaaaaagcagacgacaatagtaaacacatgcggattaaaattctgaacggcatccggcatcagataatatactaaaaacataattatcgctgcaaaatacggacaaaaacaaattaccacatccaacatatgttgcatcttcgtcttcggagcactttccatttctagcaactcttctctcgtaagctgtcttttactctccatttttcatttgactcctttgtaattttttaccatttcctttaaatgctttttaactatatcagcattttgcacaaatgtaaaattgttatttcttatatgcaatttgatttattacaattttctatagtttttatctagtaaaagtaaacttattaaccataagtatgttatactaaatacaataaatttttaaaggagatatgaattatgaattcacaaaaattatccggagcagtttcctgtcttgcagcaattcttattcttgcagcagataagatctttgccccagtatgcaaaggaaccatggaacttgcaaacggaggagaatgcatgatgcggtgtcattattatggaattgcactgtttcttttcggtctgctcctgcttgcagaatccgttcttcttttcttcggaacacacgattttaaattaccggttgtcatcattatcactgctgttctgatcctgcttcttagcaatacttcaattggcattggtatttgtgccaaggcaggtatgatgtgccacaaaactgctctttggggaagaattggtgctgttctggcaatcatcagtgccggaatcagtctctttgtacataaatcacagatgccacaggcgaattaggattcacgcaacaacatttcaaacagaatatctgattacctttcctgtaatctataatcaggagtcaaaactttctatgtacgcaaagaagccggagtctgaccgataacacaactgcctatattcaggcttttctgttatcagccagatcccagcttcttttttcgctctttaaagtgtttctgccactttcatatttgcaatcagtccccgcagctgaatcaatgaagaatatccatcagtacagtcatcaatctttccatttgccgcaggatggaaatagcgtccttccttctccgctctctttccctcggcaattgcttctctcaaaatctccctgtcttctatccgcctttcttccgggatttcattgatgatgagcattggtggctttaccgtttctgcactgttttctgtctttccctgcagttcaactttttctccacaaaatacatagccggtacagtaatttctttctgttccgatcaccttcactccgtgcgatatcagccaatcgatcgttgctttccggtccagcatatcttttggtcccgccgagatcaggaccaccggaatctgctgaagagccggaagatccgggcagagttcttctcctttgatgtccccgattccacccattccacaggtaattgcaaccggaattcccattttcacacagactgccattgtcccggaagcggtaagtgcgcctgattgcttttccactaatgccttttccagcagatcacagtcaattcttggataagcggctgcccggcttctaaattcaagaaactcatcgatatccccgatcctgatttccccatgatcaatccaggtgatcttttttcccggatcttgccattctttttttattgtttcatttgataccgattttaatccatgtgtcaataatgctgattctactaaatattccatctgttgttattccacctttctccttctggatatcaatcccgtactttttctcatcatatcatacttttccagctcaaattaaaaaaccggataaaaatttgcatttctacccggttcctgtattatttcaacaattgcatcagctcttcaaaaaagctttttgaggtttcttctgaaatcgtataatctgacgttatctctttaatgatctttttcaaccattcgtcccatttcatagtccaccttcttttccgccaaaggcttctattttgtattgtctaccgcatcctccactaaagagtaatcggcattatcgcccacaacatctgcgtacagatcatccagtgtcgggtatccataatatttccataccatgctggaaataccgtctgtctttgcatcagtcttgatcttaaagaaattgccaggtgttccatagtcagacagatcaatatctgtatttccttccccgtctgcaagaattgttccataatgcatataccagtaaacatcattcaccttgtcataagatccatcatcattactgtactgatcccgtacttttacatgataaataagatacagttcatttccattgcccacaacaggctccagcagataatctcccatataagtaaggctctccagagattcggaatctacccagttgctctccacatgatcattgtattcctgttccgcccggtccttcatttgctgcattgtatcatcatcgatgtcactggctgatgtgacataataccacagtccttttacggtatattctttttcccatttttccggcagctttcctatgttggcggcatagctgtctgccatagatttatccagatatactttaatcttgtctccgtttgccaatgttccatttgatgcatctgtctgaaaatcggcagatgtaagatcagatcctgtataatcaaatgaaacggctcctcccgggcttattccgttaaatgatacctccaggtctttgaatgcatcaaatgtcttaacctcttccagccctttgactttataggttttatttttatatttcaggttgcatttcacatattttgcataatctttattgacattccagttgtatttgactttatctttgttggaaagattgctgtccgatttcatttccacactgacataggattgcagtaccgctaccggtgatatagaatctgtattttttccatactgttcttcaaattcttttgtaaacttcagtctggaatcatattttttctgaatcttctcccagtcgatctgcggatatacatttccatatccgttatatcctgttgtttcaaaggtgacatacttgttcaaatcgattgttcttcttgcacgcgatatcaaaagccctgctgcgatcactacaacgacaaccgcacatgccagaccgatcaggaacttgttcagtcctcttgattttttatgtgtgagtgattttgtttctgctgtacttgttagcgtctcttctgtattctgggcgacctcttctttctgctcttctgcattctggacagcctcttctttctgctcttctgcattctggacagcctcttctttctgttctgctacatttttagcaggttcttcctgttccagtggttttccgcatgttgcacagaatcttgaaccatctggattctcggttccacaatttttgcacctcatatctcttttacatcctttctgtatgctatatttttctcgttcatattattaagacgagtcaaaatctagtttggttttaaaaacaagaaaaaatttttatttttttaataatgactgatctggttgatgatctcatggtatgaaacagcttcattgcccagtgcttccggctttctgtttccaaacaatttctttaatttcttttcatatttcttatttgtgacttcttttccatcccatttatactggaaaacatagtctccgttttcatcatactccggattagtattatcttccattctacattcgccatcgccgatctgtaaccattccccatctttgattttaaaaacgcggtcataaaaaacacccatatttccgtcattgttgtccagtacattgccgcccggaatataccacatcccgatccggtagatctcttcttcccggattccatccggtgtacaggtcgctacggtcgcaccatccgccatgcaggatccaacccgcacgatctcgggtacatcatctccattcatgtcaaagagttcaaaccttgtgtcatcactccactttccaacccagtctttgtaagccgcctgccattcttctttggtaaccttctgctcttttgcctggtggatattataccctgcaacagcacatcctccgatcactgccgctcctacaactccggcaacagcctttgtaccgatgattttcccggctgcttttcctgccgcactctttacaatctttcgtccggctgcctgcccgttctttaccggatctgtcttcctgattccacttttacccgaaccggtatttccgcttgtgggtgcacttccgctttttacgatgccggcaccctgtctcaccagttctttcccaaatgaaccaggcaccgatatcgtctgctcgccctctctgagcatccagagtataaacggaagcggcgctacgctgtataattttgttccttttctttccagttcttctacatcatttctgatctttttccgggcataattcagtctgctctttactgttccggtcgaacatccaagtgcatctgcaatgtctgcaaccgacaattcctcataataatacatcagcacacacagcttctgatcttctggcagaccgtccagaatttctttcatcaatcgctttgtctctgcataatccacggactcttccggtgaaaatgtcagattctcatctgcaattgtatcttcaaattcccggtcatcatcccctgtcggtatatcagaaaatagctgcggcttcttctttttcagccagtctttacatttgtttgccacaatgcagttgaaccagcttttcaaccgctttggatcctcaatcttcttcagattacggaatgcagaaatataggcatcctgcatgatatccattgcatcctgctcatttttcaccatctgaagtgcgattgcaaacccttgcacataagtcagattgtaaattttctccagagcgttctcttctccggcggcagctttttctatcatctctttcagatcatttttttcttgataattgacattcttcgctccacagtttccgcagaacttctgatcactcctgatttctttcccacatctggtgcaatacatgttttctgtcctccagtatattatccggtcgttcttttacctgtaacttaacagttcgctgatgtgcagtcccaaatctgcatccggcttatcgtatacacaaaaaaccggacagaacaactcctatccggctttttgcatatactctttcatttttttacattctgacctgcgtttcatcattcgatgctttgccttctagttttcctcagttgtcttatcgtcttctatttttgttccacagtttgtacagaatacaacaccctcttccagtggctttccacaggccttgcacactttcacttctgccttttcctccggttgttctgccggtgcttccagtgccgctccacagtaaatacagaatttacttccagggttcactttctttccacactgcggacagatctcttctgtcgataatttttcaatcatctctttgttggccgcgatctcatcctgcagggatttgatctgtgctgcaagctccggcatcttttccatgcattcgtccctgtaattggcataatatgtactgcctatctgataaatgactttttcaatttctttttctttcgtcttatttaaatttgtcaggcggaaaatctctgtcgtatcttttgccttctgtgataaatcctgaccggtttctgccaggctgcttttcagattatcaaaaaatcccatttgtctcattcctttctgtaaattttatcttaccacttttcttgcatttatcaataagcaatttacagcttctttacaatctttaaaaatcatgattcaaaaaaatcaaacactttcttccaatattcttccgcaatcgtattttccgcattgaatatctcatgtttggactctgggaacttcacaagctcggcactttccggtctgttcttgtttagttttcgcacaaaacgttcctgcgctgcattcgacaccagattatccttgcctgccgaaaagagcatgacaggtgcttcgatcttcttccatccggtcttttccagataccggttcagacgcattgcatttccgagccatccataagacggtgcgttcagatgataatgggtttccttcgtccttttttcttcataatactcaaatctcgggcgggaaagggagcagctctcttcaaattttcctggctccttgtatggcttctgaccgactacatattttttgttccttcccaccttgcaggatgtctttgcgatcgcctttgccacatgccacggcacccctccggtcagtgggcggatcatcggtgacgacagaattaccttctcaaacatttccggtactcttgccgcaactgctgccgcaattccgcctcccatagaatgtccgtacagataaatcttcatccccggattgtcctcttttgccttcttggttacaaagataaagtcctctacataacgttcaaagctgtccagatgcaccagggattcatcttctgtcagacgatagctgaagccatgtccgcagtgctccggaagatatacgctaaaaccttcttttgcaaaataataggcgatctccttatatttttccgcgttttcaataaatccatgtgacaacatcacaaccgcatgtgggttctccggaacataatgcatacagtggatcttctgccctgcatgtctttccagatagaattccgttccgatagatacaagatacggttctacgatggtctgcatttcttctttgtagttactttcctgtaaaataggtgtctgcatgtgtgataacctccccgatagattttggttcgtactttttattttctgatatgattatagcagagaggggaactctctgctataggatttctgtatacagttctttaaagttgtttaaaattataaagttgcgctttttccacttacataattcagcaatcgcattaaatctgtaatcgttacgtttccatctccattgatatccgctgcatgactttcgaatatcctttggcttaaatatcgtatacatcacaagttaattataacagaaagaaagaccttgagttcattataaactcttggcctttcttttttgggggactattcttttttcacagcccctttctctccacatttagtgatgtcctgcaatcaatgcctcaatttcttccggtcgtggcatcacccgcaatgctcccttacgtgttgtgataattgatgcggcagcatttgcataagtcagcatttcctttaaatttttctcagtcagattttctagtccatgtttacatatgtaatgcaaaacacatgcacaaaatgtatctccggcaccagttgtttctattgtattttcgtttataaaaggcgctttttcaaccatcctgtcctgataataagctctactgccttcttttcccatagataccaggataagcgggatatcatatttctccctaatccattttacagcctctgtatagtcattttttcctgtcagccactgaatttcattatctgaaattttcaggatatgacactgtcccagaccatacaatacctgctctcttgcctcatacattgaattccacagtggctcacgtatattaggatcaaatgaaatgatcgcaccagcctgttttgcaattgcaactgctttttttgtcgctctgcgtactttctcatgtgtcatagacagggttccaaaatgaaaaatccgtgtctcaagaattaattcctctggaatttcctcttctgtcagcatcatatccgctcccggatttcgataaaaagagaaatctctgtcaccatccggataagtatgaaccaatgccaatgtcgtatgtactttatcatcttttctcagaccggtcacattgattccaatttctttaattgcatcttccaattgctttccaaaaaaatcatttcctacttttccaataaaagccgttttgtgtcccaacttcgttaacattgccagaacattgcatggtgcccctcccggatttgcctcaaacaatgggtttccctggctactaataccattttctgtaaagtcaatcagcaattcccctaaagctactacgtccatttcttattctcctgctttttacattataatatcatgcttttcaacactcattgtcattttcttatcgctgaaaaaataaatatctttcgcattcagaggcgtacagattgcagtggtcgccgtctgctgtccatcattgataaaaagttcgatcgaatgataatccaggataaaacgcatctttttaagccctgccggatcctcaattctgaattttcgtacacataccacatcttttgtaacaccgcagtatgtacggtcgatttccagaagtctggtttccttattataggtataactcgtttcatactcactatctgctgccagtttgatagaaaagattgtattttctccatcttccagtgtcaccgtaagatcaattgtgcgtccctctactcctgcaagcactgtctcgccttcgatttctgtgtgttcatagcaacatggattctgataataattttccagttctttcaccggattctgccagatacggttttcttttatctccaattctctcggaaatgtcatcattccctgccagtcctgcgaattcggtatcacacaggcatcccatgatttcatccatgcgatcatgatccgtctgccatccggaagttctgttgtctgtggagcatagaaatccataccataatcaagtgtatgcggctgttctttgctgaatctgcatctgtttgcatcgtagtctcccaaaaaatacaccgaattatgtccattgtgaaactcatatttccgcgccttcatatcctgtggcgaacagatcagcacatgtttgtcttttaaagcaaagaaatccgggcattcccacatcgttcctatatcaccattttcatttgatgccagaattgtctcaaatttccagtctgtcagatttttgctcgaacaaagcacaacttgcccaacctgattatcattcttatttccaacgatcagataataggtatcgttttctttccagatcttcgggtcacggaaatcaatccggctgcatccttccggaagcatctcacctgtcacaaccggattcttttcatactttacgtaatcttttccatcaccaaatgcaatacactgattctgccgttcctgctcacttccatctgcctgctttactctggtaactccggtatatacaagtacatgctttccatctgcttcgatcgcacttccggaaaaacatcctgccttatcatattcctgatccggtgcaatcgctgccggaagctgctcccagcggaccatatcatcagtcacactatgtccccaatgcattggtccccactctctctgatatggattgtactgatagaacaaatgtattttcccatcatatacggaaaaaccattcggatcattgatccatccggtcggtgccgtaacatggaacagtggtttggtcgttttctttacatacacttgtttttctgtctcataatttcttgctttttctaacatctcactcatgcattttctcctactacttattctcttctgaaagcgatttctggtactggtcgaaatatttctgtttaatagccagataatcggaaagtccgtacttttccattttatcaaggtaagaatcccactctttttcgattccaccatttaagatccagtcggctttcttctgctctgcatattttttgatgtcggtatcatactgtgacactttattggtatcttcgatactcatgaatacatttggatatacatatttgctgttcatatctttcagatatgtttcatgcatattgtccagacgccattttgcatcctccggctgtgtcacatatacaccataatactcattgagtaccgcaagcggtccattaaccgactgtgcttcacgaacttctaccggtgactgctctccaagatcaagatgtttcaacatcttttctccgttttcattcgtagacatctcaaaaatattgaaagaatctttctctccatagcttccccagttgttctgcggtgactgcagcggtgcatacatctgatcgatccaggcagctgcaagtgctgtgtctttgcagctggtcgtcaatacacatcgtccccggtcaaatccactggtctcactgttattctgtctcgtaatgtttgtcactccggtcggccctgtcagtgccggaagcattacataatccgtattattatcaatattggcaatgtcccaggtaaaacagagaccatatctgtgattttttccttttgccacgtaggtagaccattcctgtgtaaatgcttccggatccaccagatcctctgttaccagtttatgcagccactcaatgccttctttatagccctcctgaacggttgtatagataacctctccatcatccgttacagaaaaatgatctcctgtgtctccatatccttccccaaatccattgatcaggattgccggatcctgatctccattattgataataaatgacatcggaatcacatcaccatcaatctggaattctttcttcagatcatctgcatggtcacggaatgcgatcagtacctgttccagttcatctgttgtagttggtacttccaatcccagataatcaagccatttcttattgatatatggaatatctccaatcgcctgaattgcttcctttccagctccaagctgctcgatccacgggaatgaataaatgtgaccatccggtgcggtacacatcgtacggtactccggatatttttcaaatacagcctgcagattcggcatatatttatcgatcagattttcaagcgggataatgattccctgctttgcataacgaagcagatcataatcactcattcctgcattaaacagcccatccggaagatttccgaactgagccagcgcaaggttcttcttatccgagaactgatccgccacaaaacaagtccaatcgatatgtacgtttgtctctttttcaagtctcttaaaaatgatacgctcattcggattctgcgttgatgttgcaggagcatttgtaatgaatgataattcagctttttctttcagtggaaactgaacctctgataccggagtatccggattggtttccgccttcatctgctcttcttttccacatcctgccatcccaattataatcgaaaatgtcaaacctaatgccaacactctttttctatttttttccacatatctgcatatttcctttctgactatcccttcacagaaccaaccataattcctttatcgaagtatttctggaagaatggatacattaccagcaatggtaaacttgacacaacgatagttgcatatttcagctgttctgctacttttgccatctctgctgtactctggatatctgcgatcattcccggctgaggtgtattctgaacgaggatcgatctgagaaccagctgcagtggctgcaggtttgcatcatttaaatatatcatcgcatcaaagtagctgttccacattccaacaaatgaccacagtgccagtactgcgataatcggtttgcataccggaagcataaccttgaaaaaatgttggatttccgttgctccgtcaattgcggatgcttcacgcaattctttcggaatagactggtaataggttcttgcaagaatcatattccagacattaaatgcaccagggattaaaattgcccaaatcgtatttaccatgtgcagctgattgatcaaaataaaagtcggaatcattccgccaccaaaaaacattgtgatcagaaagattatattaaagaattttcttcctacaaattccttttttgacatcggatacgctgcaagtaaagttacaaagacggagatcgcggtaaatgcaattgaatacaaaaaagaattcaaaaagccccgccagatcatatcattttccagcacacgccggtatgcatctaacgtccagtcttttatatgaaaacttaatccctggttatttaatacggtcggatccataaaggatgccagaactacatagatcagcggaattaaaattgaaagaacaaataccccaaggaacacatatgcaattcccaaaatgatttgatctgttcgtgaatatttgattttctttgttccattcatttcacgttcctcctataatccttcaccatcattcagcttctttactacccagtttacaaaaataagtaaaatcacattgattacagagttaaacagtccaactgctgtcgaatatccataatctccgtttaatagtccgatccggtatacataagtcgataatatttcagatgccggtaagttcatatctgtctgcagcgcatatgctttttcaaaaccaatactcataatatttcctgcctgtaagataaactggatcacaataatgtctttgatcgccggaagttctacataccagatctgctgcagcagatttgctccatccatacgtgctgcttcttccagttctttgctcgcattcgatagtgctgcagtatacatgatcgaagcccacccggctccctgccagattccacttgcaatataaattgttcgaaatgcagcaggcatcgtcatccagttcgtgctgattcccaaaagtttattcataggtccaaccggtgacaaaaacatacggaccattccgcaaagtacaataacagacacaaagtttggagcatagatcaaaagctgaatcttctttttgatcccctgtttgcggatctggttaagcaaaagagccaagatgatcggaaccggaaatccccaaagtaatccataaatgctcagtttcaatgtattaagcaggtaattcataaaatccggtgaagataaaaaccgcttaaaatactcaagtcctacccatgtacttccaaatacgcccttgataacgttataatcttcaaacgcaatcagcagtccccccattggaagatacttgaatataatggttaatataagtgccggcatcaggaaaaacacatataactgccaatttttctttacataagccagcttacttgccatcgttcgttttcccattgccctggtttgtttctgcatccttttcatgcaactattcctccattccctttgtccttctcgctgtataaccggtaaagtaaccggttactttataactgaatagtaccatataataatctctctgtcaatgcttttgtttgcaaaagttaccggttacataactggttattttatagttgccttttcgacttttagttgctatactatgaataagaatttttaaaggagtctattgatcttatggccaagaaacaagttacatttgctgacattgctgaatataccaatttttcaaaaacaacaatttccagatattttaatcaccctgattctctgacactcgaaaatcaggaaaaaatatcacaggcacttgatgctttgggatataaaaagaataaactggcaaaagttttagcaaatggaaaaagtgaatttgtcggtattattgtaccaaatctctatctgcactattattctgagatgcttacgcagttactttccagttattcagactatcattataagtttcttgtttttgtcagcgatcgtggtccggaagaagaagaacagtatattgatgaacttatggcatatcagattgaaggacttattgtattgagtcatacactttcttctgagaagctggcatcttatcagataccagtcattgccatcgaaagagaagctaagtatatctgtagtgtaacaaccgacaactatatgggtgcactacaggcaacaaatctcctgatccgcgataaatgtgatatcctggttcatatcaatgtcaatgttcccgattttgtaccggcatataaacgaattctagcatttaaagaaacctgtcaggaacataacgttccttatgaactgaatctgaatgtagccggagattcttatcaggatatttttgcacaaatgcatcgtatttttacggacatcgacgaaaaatatgctgataaaaagaaaggtatctttcttgcaaatgatacctatgccaatatgtttcttaatcttatttttcaaaaatatggttatttccctgacacatacgaattggtagggtttgacaattctccgattgcaagtgaagctatccttccaatcacaaccgttggacagcaaatcgatctgatcgccaaaacctccatggaactgcttgtacagcaaatggaagaacgtaaaaagcgaaaacctgtaccacttgccgaacccattcataaacaaattacccctatacttattcgtagaaaaacgacaagttaatacggcattactcccatttcttaacgattcgaaaaaagtgcatgcagccgtcaggccacatgcacttttgcattttcctatcttctattccgccagcacttcttccgcaatatttctggcatggtcggaaattctttccaggcataccagagaatcaaggaataccactccagcttctgtgttacactgctggttggtaagacgcttgatatgctttgcacggagggaaatctccagcccgtctgcctctgtttctttctcgatggtctttaacgcactttcgcggtcattggactcaaaggcttccaacgcatacagataacttgcaatgcagacatccagcatcttgttcagatgttccactccaacctcagagaaatccacctgcttttccagcagtgattccgcgaactcagaaatgttttcacagtaatcactgatacgttccatatccgacacgatctggagcatatgcgccacctcttcatgctcacgttcattgatctgcagagtcgacagcttgatcgcataggatgtgataccggcacttaaccggtctaccttgctttcttcttccttcaggaacgcaatctgttcttcttttcgttcgaacataacttttcttgcaacctccagagaatccgcaaccacatgtcccattcggacaagctcggaaacggttgactgaatcgcgataccaggggtttccagcatacggtcatccagaaggactacactttcatcctgtacctcttcttccacatgtccgatcttcttggcaagcttgatgatccagtcagaaaccgggaacagcagaacggttgtcacaatattgaataccgtatgcaccatactgatctgtgtctgggtgatatttccatgtgcccatgccggattcacaatactcagatatgcaatcgcaataatactgaaaatgatcgttccgatgatattaaagatcagatgcatcaacgctgcggttttcgcatttttctttgcacccacactggacaggattgcagttacgcaggtaccgatattctgtcccatgataatataaattgctgcgccaaacggtacaagacctgctgctgcaaggctctgcaggattccgaccgatgcagatgaactctggatgatcgccgtaactgctgcacccgccacaattccaagcaacggattgtgtcccagtgatacgaaaatattgcagaatgctgcattatctttcagtggttccaccgctgaggacatggatgaaatcccgacaaataaaagtccgaaaccaaccacaatacttgcgatatcttttgtcgaacgcctctttccggtcagcataatgatcacaccgatcatgatcgcaaccggtgccagattggacggacttaaaaatttggcccattccacactggataccagccatccggtaactgttgtaccgatgttcgcacccatgataactcccatcgcctgctgaaggttcatgataccggcatttacaaaaccgactaccatgacggtcgtcgcagatgaactctggatcactgcggtaatgaacgctccaagcagtacgccgaagaacttattctttgtaagtgcttcaagcaatgacttcatccggttgccggcagcattctccagcccctgtgccatgatctgcattccataaatgaacataccaaggcctccgacaaacggaataatgatacttgtgtacttcatagtcgtgttatctcctcttatgtactttttctttttcactctgattcttattttacaggccatttacacagccacgatttcatcttaacatcatttttctccctgtacaataaattttctttcgtagttctgacgaaaattattcccattaccccttcatctttggttcaaatatccatgatgcaatgtacccaaaaatcaatgctccgctgattcctgccgcacttgccttgaatcctccaagaaaaattccgataaatccttccttgtcgactgcctcttttaccccgttccataaagtatttccaaaaccgagcagtggcacgctcacgcctgcccccgcatactcctgcagtggtttaaatatctgtacaaaaccaagaatgcagccaagtaccaccaggcttaccatgactcttcccggcatcattttcgtccggtcaagcaggatctgcgccagtgcacagatgagtcctcctacccagaatgcattgatatagtccattttctttcctcctttaacaatgttccagcacaattccatgtgcaattcccggaacgctttctccttcattgaagctgaccgtcgacatcagcgcccccgttggtacaaaaaggatccttttccactcccccgatatcagctgtggcataatatatgctgcaagagtgatcgccgcgcatccgcagccgcttccaccggaattggtatgctgtgtctgctgatcgaagatcgtcattccgcagtccatatgattttctttgatatccagccctttcttacgaagcagatcaaataaaatcgattgtcccacatagcccaggtctccggtaatgatccggtcgtaatccttttcaccccttccaaaatccataagattctgcaaaatcgtatcacacgctgccggtgccatacacgctcccatattctgtgaatccttcagcccataatccacaattttcccaatcgtcactccactgatccgcacccggcttttcttttttcctaccagaaaggctccgcttcctgtcactgtccaggtagaagaaagtggtctctgattcgcatagccaagtggaaaacgaaattctttttctgcacttccaaaatgactcgatgttgcagcaagcaccagatctccatagcctgccgccacagtcattgcagcaagggcaagtgcctctccggatgtggaacatgcgccgaaaagaccaaacaccgggatctgaagttcttccgcccccatcgatgtagcaattccctgtcttaaaagatcaccgccaaagagatatcgtacctcctccggctgtactcccgcatttttcaatgccagcttacacgcaagcttctgcattgttccttctgcaagctcccaggttttctctccaaaaaggtcatcctccgatgcaatatcaaaatattttccaagtggtccttctccttctttttttccggcaaccgatccggcgcttaccagatacggactttccgaaaatgcaatactctgtgtccctttcatcgcattcatgtccatccctccttgctcacacaattccgatcagcgtcccaatccagtagagcagtcccagaacccagctggtgaaaactccgtacaggatcacaggtcctgcgatcgtaaatatcttgcagccaattccgaaaacctgcccctcttttttgtattcaattgccggcgccgcaacggaattggcaaatccggtgatcggcaccagtgctcccgctcctccccagttcgcgatcttcggatagattccaaatccggtcagcaccacacttgccaggatcaggatcagtgaacaccagcttgcagaaatatcctttgacattcccgccttttcgcacgcatttaagatcgtctgtccaatcgtacagatgatcccgccggtcacgaatgcttttgccatcgcaggtccgggcttcctgaccggtgttttctcttttacatatgtttcatactctttttctttctcttgttgcttcattttctcctccagttaccatcttttatagaaaaacagaagtgctccaaggcttttcccaagcgccatcccaaaaatcagccatggcacacatttcaggattttgatcctccggataaagattggaaaaatattcaggatttccgcaagtgccattgaccagcaaccaacaaaaattccggaaaaaagtccaaacaccggaacgatccatttgccgccaggcattgcgagcccgtatacccagaaaatatttccaaggatcccacctgccataatgcagttttcatacagcatgacatgcttcccggtatgtgtccggtctgcaaaatctgacactacgccaagtccgataataaatgaaaacagtcctgccgcgactgcaaatccggatgcaagaccaaccaccgccaccagaatctgcctaatccacatcgacttctttttcctttctcgcataagcttcgatcaaagtttcctgaatatcattttcatacaaacgcatttccacttccatcggcgtcggatctgctgtaaatttctttcttcctaaatgattgaagaaaatcaggatccctacgatcagcccgatgcagtaagtcagctctatcagggtaaatccattcgattcttctccggtaagaagcagataaatccgggaaaacatctttgtcaccgacacatcattgttaaatgccatgatggaaaatgctgctccgataaatgtgattcccgcaactacaaccactttaattccctgccagatagcatttcgttttttctccccttcataggtaatgatcaggtcactttctccttcgttctgaatctgtagtccgggaatttcccgatggatacattctatgattttcagaacagacaccacatatctgtgctgttcttttttcgggattttcaggatccgcagtggtttaatcctgttcatgatggaagaattgctgcattccattgtcaggatatctcccaatgtcacatttggttctttcacctcggtattcttttcccctttgatataaagtatttcatttcccgaagacatctgtatccgtcctttcttttaccggtagcgcctgccagatcagcgttccttcacttacctggtctgtcccccggacatcattataatagtagatcattccgatcagaacagctgtcagcagggcacaaagaacacagccccagatatatttttttcttctttccaatcgcatccgcctcctttgtgatctgtttcagataggaaatagtatccctgtttttccagaaaacatacatccttttattcttttgcgtgttcccgcatggttttcaggatctttttctccatccgggatacctgcacctgggaaattccaagctcttcgccgatttctgtctgcgtcttatctgcaaaatagcgcagatacagaagctttctctcgtctttttttaattcttttatcagctctgtaagcagaagatgatccaggatcttttcttctgcaccgcctgtatctgcaatcttttccagcagcattacttcatttccatctttcataccgaccggtctgtgaagcgattccacttctcctgctgcctccatcgccatcaccagctcctctttttccacacccgtttcttccgcaatttcttccagcagcggttctcttccaagcttttccgtgagcgcctcctttgcctgatatgctttatacgcaatctcttttaaggaacggctgaccttcaacatcccgtcatcacgcaggaaacgctttatttctcccgtgatcatcggaactgcataggttgaaaatttcacatcatagcccagatcaaacttatcgatcgcttttaaaagcccgatgcttccgatctgaaataaatcctctgcctctgtgccccgtccgtaaaatcttttcaccacacaccagatcagaccggtgttttcctccacaagctgtgccctcgcattttcatccccttcgtgagcccgtctgatcaatgcgattgtgtggtccatacagcttccttcttttcccctcctgtcgttttcttcatccaaaccgtagtcccttttccaggcacagattccacctgtacttcatccataaatgcttccataaatgcaaatcccatcccggaccgatccatatccggcctggtcgtatagagtggctccatcgcctgctccacgttttcgataccgatgccctgatccttcactgtgactagaatggtcttcttatctttttcaatcccgcaccagaccgtgatctttccggacgtccgtccctcatatccatgaataatactgtttgtcactgcttcggaaaccgctgtcttcacgtctgccacttcctccagaaccggatccatctgcgtcataaacgcagccactgccacccttgcaaatccctcattctccgatctgctgtcaaaaactacttccatctcgttaaaatattccattacatcattccctcctcataaatctgtatgatcttcgtcacgccggacatattcagaatctgccgcatccgttcacttgtatgtatcgcccatacttccccgccaagaagaaagatatgccggtaccgtcccatgatcactccaatcccggaactgtccataaaattcgttcttccaaaatcaaagatcacatatttgatatgttgttcctcgatcaccttatccgcctcccgtttgatctcctccgcattgtgatgatccacctccgccggaagaaaaatcgtaagacaattttctttgatctgatactgcatttttgcttaaacccctttctgtcttttttatttatacaaatacgccaatagccttgatggatttataaaaagagtgcgcatttacggcacgtagtgccttttgttttataggaagttccttcggaatttcctataaaataaaagagaaagtaacgccttttttcgctactttctcttttgtgccttttatattttattgtccctgggtgcctgttccaccggaagtattctccgaagttccatctgatcccattgcatccagtgcgctctgtgccgaatatgctgcctgtgttcccggataatcggtcgctgctttttcgtaattgctctttgcattgtctttatcacctttaccggcatacgcgtctccaagaagcttgtacacaccaccatcactataagagtcatccatcttcttgatcttttcaagatccgaaatggcatcatcataatttccactctgcacttcatactgcgcggtcgaatacaggctcacacatactcgtgggaacacggaaccggagatcgaatcgtagattttctgtccctcttctcccaacgaatccctgttcagtccaagcaacgtatctgccatatccgcattgctcgttgttccgccataatactgctgatataccttgatcagggcatcatagctgtcctgtgtggatgcggcggtctgctttgccgattctacctcatcactgctgttacggtatccctccagttcatccttaagcgtctggatctgtgtcttctgtgaagctatctgctcgcttagtgcaatgacattccggttttttgtagacgactttgtctggtttaccgccggagcgatcaggaaccacaccactgccgctccaaccaccataccgatcagaatattgacaactgtcatcactgccgcattgtctcgcagtgtcgctgcaggctggatgatcgtctcatttcccagattgtatgtgacaaccgactgtctgccatgcttttcctctttaatatgtgcaacctgccgattccgctgacggttcagctcatgcatataccggagcgtaatatcattcgtcacatccagcttgagtgccgtcttcaggctctgtcttgctttggaatactgtccggaatgcatataaagaagtgccagaagctgatatgccttcaggaaagacggatgtgccacaaccacctttttcagctggatgatcgcaagatcttctccattctgtctgcagtatccaagacactggttgtatttgtgaactgcctgattcaccttctccagctcacttggattatcctgaaccttactgatatagtaactggcaatattctctgaagccctgaagtttttactgatgatccactctacaagagcctccgctacttctccacgtccataatagacaagtccgagaagattcctcgctgtgatattttctctgttaaactgcaaacttctttttaacgacacaattgccccggacagatcccggatctgcgctttcttcagtccatcattgtaccagtagttcgactggtactcgagtttctgcttatagtccatcaaaatctcccctattttttctgatccatcatctctcttaagatatctgtcatatcagacagatcctcctgatatactgcattctcgatatcttctacttccagacttggtttgaacttcttaagttcttcttcaaaattaagcatcttctcctcctatcagttcttttaactcccctaccagatagagcgaccccagacagtaaagtttcccttcgctgcccttttcattcagtgcacgtgtaaatgcatcagcaagcgtgtcctcccgatagaccggtctgtctgtatacttccggaacaacgcggcaagtgtatctgcctgcgctccccttttattatctactttggcaatgacataagcatctgctttcgattctctgcataaaagctcgatcatatgactgtaatccttatctgcaacagctgaaaaaaggattatcagtggatggatttccccttccgcctctctttgcagccggatactctttgtaaattcacggattgccgcaagattatgcgccccgtcaaagataactccgggaagaacctcttccattcttccctgccatttaacagatgcaaccaccttctgccatttgcagatttctgccttgtcgccaaatgtatatctcatcgcccggattgcaagtgctgcgttcatcacctgatagattccggtgctggccacctgccatacggtattattatcatactcatccaaaatagaaaaagcaatatgtttgtctgtaatttcttgaattttcaacgcatctttttccattttataccacggtgcttctacattttcggcagtttcttctataacccgactacttctttcatcagagccgtcaaaaaataccggtacgccttttttgatgattccggctttttctcccgcaatcttttcaatcgtatctccaaggatctctgtgtgatccagtccgatcgatgtgatcacgctcaggaacggatgctcgaaggaattagtcgcatccagccttcctccaagtcctgtctccagtacaatatactctgcatcattctcttcaaatgcaagcatacccattccatacaggaattcaaaataagaaggatgttccagcccttccttttccagttcttctgccacctgccgcacctttgcaaaaatccggcagaaggtatcatcgtcaatatcttttccattgatccggatccgctcgttgagcttcaccagatgtggtgatgtaaaaaatccgacacgctttccctcaaaaagaagaatcgcctgcatatatgcgcagacgcttccctttccgttcgtccctgccacatgaagaacctttcttccctggcagggattccccaatcttctcataaattcacgggtatgcaaaagcgtatgcttctttgtaaattttggtatgtcctctatatatcggactacttcttcatacttcacaatctttcccgtctttcttaagcggaactctactgctgcccgctcttttcttctttattattctgatcctgctgttctccggactgtccggcattttctgtcttctgctgatcgccgtccgtctttgcagaattcttctgttcttttacttcatctgtatattccaggatttttccatccatgtaaatatattctcttgaagtcctgaagatggtattgcttgatccgacctggctgaccgtaatgatgtctccatccttcagcttactgtccggaagttcgatccttgtattattgaggaaagtagattcctgcttttcatcattgatgtaaaccttgctccatttagtaaagtttgttccgtagaggctgtaggtctcatccagattttctacaagatccgtgagcgtaacctccttgatccccatctgcatatggccttctgtgatcggcggcttaccattgtatacatactggtctccatacagaatatcatactgtaacagctccagatccttcagataatcctttgtctggcgtctctgctggtgatagttgaataccgtaccggaatgtaatcccaggcggtccatcacatccgccatgatctggtaggacggaatgttccggtcctctttctgaagtccaagattgtcccagatcacataatttgtattgtacagataacggttcttcatatcctttgcttccagtcccattgtcggcagatggtcaccatagaatacgaccacagtcggctcaccgcgttcttccatcatttttaccagattaccggcaaactgatccatctcatatacctggttcacatagtattcccaggcattgttcttctcttctgtcggtgctcctgttacggtgatcttcggattctcaatcaccttttctgtcggataatttccatgtccctgtacactgactgtaaatacaaaatcctcctgctcggtagagtccagagcgtctttgatgtgcgtcagaagaatatcatccttcgaccatccattctctgttgtctggagaatattcataaactctttacttgtaaagctgtcaaaaccaatattgttaaataccttcgcacggctgtagaaattaccaccgttgttgtgaatcgcatgggttccgtaaccgaatgcagaaaatgcagttgctgcactttcacatacctgattcttaagctttgtcttataaggatactcgcccggtccgaaataacgcaggttcatacctgtcagcacttcaaattctgtattggctgttccggctcctaccgaaggaaccttaaaatatccggaagaataattttcaaacatcttgcgcagattcggaatcggatcctctgacatctgcagatcctcatattcaataggatcaaagaaagattccagctgtacaaacaagacattcggtctcacaccattgtcggatgtgctctctgtcatctctctattatccgtgatcttctcgatcgtgtctttgttataatcattcggttctgaaatacctgtattaaaaaggctggccgagaaacaatacggaagtccgtaatcctgataagcaaatgcgatatttccaaaataagtagaaataatcctcttatctacagcaacatttgtcagtacagaatatccaaaaaacgctgcaacaacaataatcagcatcgggatcctgtgcatctttccttcatactgtccggcacgtctccacatggcaaccagccagatgagcagtgccggaacaccaattcccatcatcacaagctctgccaccgagaaatagtttgtaaacagtgacaatccttctgtaaatgtctttagatcctgtgcattaaacggcgtaacacgctttgccagcatcactccgttgacaacacccagaaagagccacaatgcactgatgatcagtcgtgtaaacacccggcgccgcaccagataagcgattaaaagtgtaacgaaaatcattccggcattgtacaaaaataccagcggtgttcctgtcatatactgccaagctgcaattgcagaatgtctggacagtgcttcaatgataaagttaatgatacaagcccacagtgcctgaagcggcaaagagaaccggttcattatcttatagtacggtgccatcttttttgcgaatttgctgtttcgccgcttttcaagaatctgctgtcttcgctcatgctgcttttttaaatgcgcctttatatctcctggcttcatattcttcagcttctgccattttcctttcagatccggttttttccactgaatctttttaaaatgaatttccttcatcgtcttttaaccccttacgtgtttctgtaccggcaggcgcagtttatgctgcatctgccggtatatccggctaaaaaagaatatgccttagtactttcctgcagtgattatcttcctgcctttaaagcctccagacgttctttcacctgttccatcatctgtgtatacttttcaagctttgctttttcttcatcaacctttgcctgtggtgctttgctgacgaatttttcatttgaaagcattccctttgcacggttgatttcttttgtaagcttttcttcttcttttgtcagacgctcgatttcctgttcgaagtcaatcagctcttccagtggtacatatacagaagcatccggtactacgatcgatacggcatcatccgcaatacctgccttatcagcctggacaacaagttcagaagcactcataagcgggcatgcgcatgttgtcagctcttcgaatccttcacagagcttctcatcttcgcatactacataaacctttgctttacggctcggcggtacattcatttctgcccgcgcatttctgacaccacggataacttctttcatatgatctgttatattttcagcgtctgcataacaccagtcttcgctaaactgcggccagtctgacatcatcagagatttttcctccggtaccagtgcgctgtagatttcttctgttacaaatggcataaatggatgtaacatcttcagtgcattaccaagaaccgtcttcagtgtccaaagtgctgcattggcgctcttataattttcatcagaatggtagatcctgtattttacaagctcgatgtaccagtcacagaattcatcccagataaagtcatatactttctgtactgcaatacccagttcaaatttatccatgttctcagttacatcttttgcaagtgtatttaccttggataaaatccatttatcggttacttcaaaatctgcctcatccggtttggaaattaccttatcttccatgttcatcatgataaatctggatgcattccataccttattggcaaagttacggctggattctacacgttcgttgtagaaacgcatatcatttccgggtgcatttcctgtgatcagagtcagacggagtgcatctgcaccgtactcatcaatgacctccagtggatcgataccatttccaagagatttactcatcttacgtccctgggaatcccttaccagtccatggatcagaacagtatggaacggtgcttttccagtatgtgcatatccggagaataccatacggattacccagaagaaaataatatcataaccggttaccagtacatctgtcggatagaaatacttgaagtcctctgtctcttccggccatccaagtgttgagaacggccacagtgctgaactgaaccaggtatccagtgtatcttcatcctgtgtcagatgtgtgcatccgcaatgcgggcatttttccggcatctcacgtgcaacaaccacttctccacattcatcacaatagtaggccggaattctgtgtccccaccagatctgacgtgaaatacaccaatcacggatattttccagccagttcaggtagatcttaccaaaacgttccggtacgaattttaattcgccggtcttgatcgcattgatcgccggtttggcaagctcatccatcttaacaaaccactgtggtttgatcatcggttcaacggttgtcttacatctgtcatgtgttccaacgttgtgtacatgttcttcgatgcttacaaggtatccttctttttccagatcttctacgattgcttttcttgcttcgtagcgatccattccggaatatcttccgtatccttctacgatggtagcatcatcattcaggatgttgatttccggaagattatgtctctttcctacttcaaagtcattcgggtcatgtgccggtgtgatcttaaccgcacctgttccgaattctttatcaacgtaagcgtctgccacgatcgggatttctcttccaactaacggaaggatggcattctttcctacgatatctttgtacctgtcatcgtccgggtgtacggcgatcgctgtatctccaagcagagtttccggacgtgtagttgcgatctcaaggaaacgttctgttcctacgatcgggtacttgatgtgccagaaatgtcctgcctgttcctcatgctcaacttctgcgtcagaaagggaagtcttacataccggacaccagttgatgattctggaacctttgtagataaatcctttttcgtgaagacgaaggaatacttctttgaccgcattcgagcatccttcatccatggtgaaacgttctctgtcccagtcacaggatacaccaagctttttcagctgaccttcgatggttcctgcgtactcttctttccactgccaggttctcttaaggaatccttctcttccgagttctttcttatcaattccctctgcctttaactggtttgtaacctttacttctgttgaaattgcagcgtggtctgttcccgggatccacagtgcattatatccctgcattctcttgtaacggatcaggatatcctgaagtgtattatcaagagcatgtcccatatgcagcttaccggtgatattcggtggcggcattaccgttgtaaatggtttcttactcctgtcaacttcagcgtgaaaatacttttcttcacaccatttttcataaagtttcgcttcaatctctttcggattgtaggtcttttcaagattcttactcattgtttcctcctcttataagtccaccgcgcacttttgctctctctataaagaataaaaaaagccctttacaatatgtaaagggcgtgtataaacgcggtaccacctttgttccacgaaataaatccatctcgtatctctcacagttctataacggaaaccaccccgtgatatcctactcgccctttttcagatacccggctccaaagctaccttctgcaaccacttcccgtaaaccgtctctcagcctgtgaacggttctctcttcttcggaccagtctgcatactcctctttctcattgccttttcccataactattgataatcatagtattcaaagtccgatttgtcaagaagttcatgaaatctttagaacttcttaaagattaaatttttcacttaactcaaaaaaggcgaaatccctctgaataagaaagatcccgccctaacttcctaagcctcgtcaatcgcttttccgatatcgtggcgcatatatttgttatcaaatttaacccattcggttgctttgtaagcattggcacgggcctctttgagcgttgctcccttggctgtcacaccgaggacacgtcctccgtttgtcacgatctggtctccgtcgaatttggttccggcatggaagcaatagtatccttcatgcttcttgaactcgtcaagacctgtgatcggaagtcctttttcataagcgaccggataaccgtcagatgcaagtaccacacagactgctgcattgtcttcaaactgaagatctacctgatccagtgttccgtcgatacaggcttcgatcacatcgatcagatcatttttcatacgcggaagaacaacctgtgcctcaggatctccgaatctggcattgtattccagaaccttcggtccgtcttcggtaagcatcagtccgaagaagatgatccccttgaactctcttccctctgctgccattgcatctaccgtcttctggtacacatatttccggcagaattcgtcaacttcttttgtatagaaaggactcggtgagaaagttcccataccaccggtattcaatccctggtctccgtctttggctctcttgtgatcctgcgcgcttgtcatagtcttgatggtctttccatctacaaaggaaagaacagaaacctcacgtcctgtcatgaattcttctacaaccatggtattaccggatgcaccgaatttcttgtccagcatgatctctttcacgccggcttttgcttcttccaacgtattacagatcagtacaccttttccaagtgccagaccatctgccttcagaacgatcggaaatttggctgtctccagataagccagcgcttcgtctgcattgtcaaagttctcatatgctgcggtcgggatgtcatattttttcatcagatcttttgaaaatgccttgcttccctccaggattgctgcattttttcttggtccgaatgcgcggatcccggctttttcaaattcatctataaggccgccaaccagcggatcatccattcctacgattgccagatcaatctctttttcctttgcaaatgtaaccagcttgtcaaattccatcgcaccaatcggtacacattctgcaagctctgcaatcccggcatttcccggtgcacagtacatcttctctaccttgctgctctttgctacacaatatgcaattgcgtgttctcttccgccaccgcctacgatcaatactttcattggtgctcctccttctctaacgggcaattgacactctgccatcttttactgttacttttccatttgcgatcaggtcgatcgcatgtggaaggatcttccactccgcctgctccatcactcgtctctgcagaacctccggtgtatcgccttcttctacttcaacagccttctggagaatgatcggaccggtatccgttccttcgtctacaaaatgtacggttgctccaaccacctttacccctctggcaagtgctgcctcatgaaccttcagtccataatatcccgttccgcagaacgacggaatcagagatggatggatattgatgatcttatttcggtatctgctgatcatttcttccggaatcacaaccaaaaatcccgccagaacgatcagatccggtttcagttcgtctaccttttcaagaaaaactttgttaaactcttctcttgtctcaaaatccttcggcgaaacgcactgtgccgggatctgatgattcccggctcttgtgagtgcatatgcgttcttattattgctgatgacaccgaccagctctgtattggtgatcgtgccattttccactgcatcaatgattgcctgcagattggttccgcctccggatacaagtacagcaactcttaacataaagtaactcctttttctcctgcttctacataaccaaccacaaatgcttcatctccagcttctttcattgccttaattgtagcatctacatccttttcatcgacagcgacaaccataccgatacccatattgaaggtattgtacatcatctcttctgcaatgttgccagtctttgcgatcaggttgaagattgcagggatttcatagctgtccttctttaccactgcacggattccttccggaagcattctcggaatattttcatagaatccaccgcctgtgatatggctgcatcctttgactcttacaccggcttcttttacgttcttcagtgcttttacataaattctggtcggagcaagaagtgcttcgccaagtgtctttcctaattcatcatagtatgtatttaaggattcttctgtaatgtcgaataccttacgaaccagtgaaaatccattgctgtgaacccctgtagacggcattgcaacaagtacatcacctggcttaatatcagaaccgtcgataatgtctttcttatctacaactccgactgcaaaacctgcaaggtcgtaatcattctctggcatcagtcccggatgttctgctgtctctccacctacaagtgcacatcctgactgcttacagccctctgccacaccgcttacgatcgtagcgatcttttccgggtaattcttgccacaggcaatataatccaggaagaataacggttctccaccagagcatgcgatatcattcacacacatggcaacagcatcaataccgatcgtatcatgcttgtccattacaaatgcaagcttcacctttgttccacatccatctgttccggaaagaagtactggttcttccatattcttgattccacttaaatcaaatgcacctgcaaaaccgccaagccctcctaacacttccggtctcatggtttcttttacatgctttttcataagttctactgatttatatcctgcctcgatatctacgccggctgtcttataatccaacattttctatatcctcctggtattttcactgacatctgtatgcctacatctgcttgatatattctttgtgtccgattttttcaagcttttctgcttttttctggacggtttctttcatttctgcagtgtaatccttcaatttctgaagaagctcaggatctgaggttgcaagaatctttgcagccagaatagctgcgtttgctccgccatcgatcgcaactgtggcaaccgggattccaggcggcatctgaacgattgaatagagtgcgtcgacaccctccagattcttccctgacattgggattccgataaccggcatcgggaaaattgctgcacacattcctggaagatgtgctgccatacctgcacctgcaataattactttgaagtcttttgcttctgcagacttcgcatattcatagaatacatcaggctcacggtgtgccgagatgatcgtcatctcataatcgattccaaacttttccagcatgtcggcagcttttcccattactttcatatctgagtcgctgcccattacgattccaacttttggcataatgatctccttttcttttatctataagtattttaataaatagctaaccacttataagttattttactaagtctgttgcggtatgtcaaccgttacttatctgaccattatttaattttacttattggtattattgaaaatccataactaatactaattcagaggttcattgaggatctctgttcccggaagaacaaaccgtccatcacggataatttctgtctctgttccgtctttcgccactacaacaatgcttcccagctcatcataagggatggtgatatcggtatggcactggaaatatgctttcgacggatcctcttttctcaagatcgatatgctgttgtctcttgcaataatctcttttccatccggattgtaaacctttacatcctctgcccagctgtagcaggtatcccctactgcaaaatgcggtcccgtcttttcagcgatcagaatcgtatatttatctgcaatatcatatttcttcgcaaccgcataagctgtggtattggttccgatcgcaaactcgccgatcggaagtgtctgatgattgtgcagaatgttatcgaaaatatattttttattttcttcttctgaatcaaaattggtgcaggtatactctgtgatctttccttctttaaaactgatcttcagattgtaatacggaagtccgtgaagaaataccttgctcacaaaaagggtaccttctgttccttccagtaccggggaagtgaacacctcacctaccgggatattgacatcggcaacacagttttcaaagatcgtctcttttgccggatcggcaagcggatgaagcatcactttcagatccgtctggttttcgcctgagcctgttacttttacatactctcctttatccagtgcatcgatcattgtctgctgcaccttctggtaaagcttgtaatccagagtattgatcttgatcgtttcatcaaagatctcatgatactgctctccgatttccggaaccggccaggaaatgatcgtaaagcttctctcatctcccggaagatattcattggtcagacgtccggctcttccattcatcgcaaccagaagttcttcctgcttttcgcttaatttaactgcctctggtttagcctgcggaacaaaagtcttttctccgaaaatgtcgatcactgccggtcctgcatagcctgctgcaatctctttattctgctcgtaagtggtacgcatcacttccagctttcgctctacatactgtttatccatcacaagcccgatatcatctctgtggtcatagacatactgcttgttgccggaaatattgaaaaatccgatctggctgttacgtcctcttgtgatcacgctgtgacttgttcggaaaatactcggctttaatcccattttggcaaaattctcaatggctttttttacgatccgttcaaatcccattgcatagtaaatgttgactacagatttttttgacaggtcttttccggtatttacaaaaccaatcctgtatccttcactgaaggtatctgccatcttatcaatcttctcctgtgaaagtgaatttaaatatgcggctgtctctctttcatttacccccacatattctcccatacggtagagataacgcagatcggaaagatcttcattcatgatcatattcacaatgaagcatcctctttccggatcgatctggtctttgatgcggtctgccgcaaatacatcacagtaatcacttgcataccagtaaaagatttccttcaggctttccggctgcggctgcttttcttcttcaaatttgttgtagatttcaatcaaaagctctgctccgatcacaacatactccatacgctgttcctgaacataagaaatgcttccgcgaatctcggtgtaaaccgcagacaaaaagcttcccagttctcctcccagcaccaaaaccgcataagccggatttgcataagatttctcatagtttgcttccagttcgtctgcataaagatccttcatctcttcctgcagctcttcttctgacatctctttctgctttccgctttccacattctgtttcagctcatcaagctttaaaataaaccgagccacatgctggaaatactcccgatatggctctgctactgttttttcttctattattgcttttattctgtcaattgccagattatatctttcttccatttatacacatcctcttataaatactaagatcagggcaagtaaaataaatccgtttacaacaattccgatcttgcaggtcagataatttttatctctttctttaaatccttttacacccgttacaataccgatgcaggcaagaatcatatcgaaaaccccaaagcttcctaccattgctgctgatttccctttattcataaatgccattacaatcaatcccgctatcactgccgtaacaagtactgccatcacacaggaccagattcccttgcgggaatgctttctttttatctgaccatacttccggcttcttttatttcgatctctttcgcgtgctctttttttatctctcctgcttcgcatcgtgccatctccttatcatattacaaatcgcgaagacgatatacccgatcacaccgccaagggtgttgagcagcatatcatccacatcaaaactccccactcttgttaccagctgaaagcactccacaaagaagctcactccaaaactgtagaaaagggtaagaaaaaagctgcgataccggcttgccatcggcataaaaaatccaaatggtatgaaaatcaggacatttccgaacagatttgcataagatacccatcctaaaacatctcgatacagccaaaatctttttatttcacagaaaagaaccaggttataatgatattccccggttccttcccgtccataccagtcagaaaaaatcagaaagtaaaataaaaatccaatatacaggacaaataaaatcttcccaagaacccgaagtctttttctgttctttgctttcaacttaaagcgcccttcctaaaatgtcagtccctttttcgcaccaagcagctttccaccgctgacaagcaaaatgatcccggttgtcacaccaacaacaatagaaataattccgatcgcaatattggcaccgccggcaagtcccatcaccttatatgtcttttctgtcactgtaactcctccttattttgcaccatactgctcatagtatgcgtcgattgcagccttgatcttgtcatcgataacaatttcaccattgcatggtttgttgtacagatgctctactacatccttcatggttacgattgcattagtttcaaatccgtaaagatcctttacttcatcgagtgcgcatttcacaccgccttttcctacttccatacggtcaagggataccatcagtccaacaattgttacatcagcggctcctcttaccttcggtacagtctcttccatggatttgccggatgtggtaacatcttcgatcataaccacgcggtctccgtcctgaagcttgcttccgaggaagcttcccttatctgctccgtgatctttttcttctttacggtctgagcagtaacggatctcttttccgtataattcactgtaagcgatcgcggttacaactccaagcgggattcctttgtaagcaggtccgaataatacatcaaaatcatccccgtatttgtcatggattgcttttgcgtaatattcaccgagtcttttgagctgtgatcctgtcacataagctcctgcattcatgaagaacggggactttcttccgcttttcagtgtaaattctccaaatttaagcacgtggctttctaccataaaatcaataaattcctgtttgtagctttccattttatttatcctccatctcttatctgttctttattttacaattccaaccatatctttcacagactcaaagccattcttcttcatgtaggcttcaattccatcgatcacttccatcgtcactgccggattgtgaaagttggctgttcctacggatacggcacttgctcctgcaagaaggaactcgatcgcatcttctgcgcaggaaataccgcccatcccaatgattgggatattcactgcctgtgctacctgatataccatgcggacagcgatcggtttgacgatcggtcctgatacacctccggtcttatttgccaccgcaaatgtcttacgattgatatcaatcttcataccggtcagtgtattgatcagggaaactgcgtccgcaccgcctgcttctgccgcttttgctatctcagtaatatcggttacattcggtgtcagcttcatgatgatcggctgctttgcgatcttcttgatctgtccggtcagctcttctacatgctttgcatcctgtccgaaagcaaggaatcctgcattgacattcgggcaggaaatgttgatttccatcatatcgatcggttcatccgcaaggcgttctaccacttcaagatactcttccggtgcatgtccgcagacattcacaatgatcttggtatcatagtttttcagatacggaatatctcttttacagaacaaatcgattcccggattctgaagtcctatggcgttcatcattccgccgtaaacctcggctacacgcggagtcggattgcccggccacggtacatttgccacaccttttgttgtcacagctccaagcttgttcagatctacaaattcagaaaactcttctcctgatccgaaggttcctgatgccactgttaccggattcttccattctactccggcaatatttacacgcatatccattagatttccacctccgtagaaagaaataccggtccgtctttacagatacgtttgttgtgcacattgctgtgcgcatccttttcctttgacttgcacacgcacgcaagacatgcaccgattccacatgccattctctcttccagagaaatatagcattcgattccgtttgtttctgcatactgtttgatcgcacggagcatcggagttggtccacaggcatagatcatatctgcttccagcgcattctcacggattgcatccatgacatttccttttgttccgacactgccatcttcggttgaaatataaagctctcctgcctgttcaaattcttctttcaggaaggtatgtgcatcacggtatccaaccacaatctgctttttctcacattccatctgttttgcaagctccaggatcggcggcacaccgattcctcctcccatcagaaataccttctttccttcggccttctcaaatgggaatccattaccaagtggtccgatcaccggaatggtatctcctgccttcatctgtgaaaattcttctgttccggttttttcccctgttacacggtaaaccacacgaagttttccaccttctttatcgatctcacagatactgatcgggcgtggaagaagcttgcttccatcattggtatacatggaaataaactgccccggtcttgcactccctgctgcttctgtttggatccacatactgaagattccatctgcaagctgctcctgcgatacaacctttgcctgttcttttttctttgtagtcatcttctattctcctataatccggatttgccggtatgtcagaagcttctgtcacaccggctcattcttttctcttatctgttctcaagcgcgcctttgatatctgctaccatggcttctactgctgcacgggatgcatctccaaagttctctgcaccgtattttgcataagcttcctgcttatatgctgcaatgattcctctggatgagtttacgattgctccaagtccatcttcattgaagaaatgaaccagatcttttccttttccaccttgtgcaccgtatcctggaaccagaatgtaggatttcggcattactttacgaaggacttttcccatctccggataagtagctcccacaactgctccgatgtagctataatcatcacccatgcagtctgctccccactcggcaaccttttctcctaccagttcgtaaagcggacggccatcgatcagccgatcctggaattctccactggatggattggatgtcttaacaaggataaaaagacctttcttctcttctttacatacttcgataaatggctttactccgtcagatccaagatacggattcacagtagcgaaatcttcatcgaacggtacataggatttgcttcctacctgaactcttccaagatgtccaacagcatatgctgctgaagtagaaccgatatcacctctcttgatatctccgataacaacaagtcccttttctttacagtagtctaccgtcttcttgaatgcctgaagtcccggaattccgaactgttcgtacatagcgatctgcggtttaactgccgggatcagatcataagtcttatccacgatctctttgttgaactgccagatagcttctgctgctccttccaaagtctctccatactctgcaaatgcctttttctgtacctgttctggtacataggaaagcatcggatccagtccgacaacgataggtgctcctgtttttttaatgttagcgactaatttgttaatcatcttattccctccagttttctatttatatttttgctgtaacagaaagtattgtccttttgttacctgaaaaaaaatattctttacttatgatatcatattaaaaactaaaagggaatgccgttttcggcattccctccggatttctgttattgattgattttatttctcacctgtttcaatgctgcatcaagctgattatctgcattcggattattctcatcccgctgatattcaacttctacgtccggcgtaattccttttttgtgaatatttcttccgttcggagtatagtactcagccattgtcagcttcacacaggttccgtctccaagatcaaaaatctgctgaacgattccttttccgtaagttgttgttccgacgatcgatccaagtccgtagtcctggatcgctccggcaaaaatctcggaagcacttgcactgttgccgtcaacaacaaccgacatcggcttcgtaaactggtgttcatcatccgatgagatcacctcttcgtgaccactcttgtcttttgttgacacgatcgtaccttttggcaataacagatccaacatctgtgtgactgtcgcaagattgcctcccggattcgcccgaagatcaaccacaagtcctttcatcccctggtcctccagactgccgagtgcactcttgaactggtcataggtcacactgtcaaattccgtaacccggatataaccgatctggtcatccttcatttcagacttgactgtctccacctggatttttctccgggtaaccgtcattgtcacttccttcgcatcatccccacgcaggactgtgatatcaacagtcgtattctctacaccgcggatcagctgtacaacatcggaaagatccgttccacttacatccttatctccaaccttatacagaatatcatttacctggatacctgcttcattcgccgggctgttctcataaacctgaactgcagtgatcaccttagtttcctgattctgtgaaaaaacaactccgattcccgaatactctcccgaagttgattcctgcagggatttagtctgttcttcatcatagtatacggaatatggatctcccagtgcattaatgtatccactgtaaagtccgttctccagatcttcttctttcaaatcatctgtataaagataattttcatcaatcagctttttcagtttattcagttttttctcttcctgcgcatttacaaccttttcctgactggttccaaggtctacacctgcaacattcataattccaagtgccgcagcacctaccataaacatggcgagggcgcctgcaagcgcccccttccaaaaattctttttattattttccatcatttactctttcatacctgttatgtattatcttacagatagttcagtggattgaccggtacaccacctacatgaacttcaaagtgaagatgtggtcctgtggaaattccggtcgtaccgacatttccgatcacctgacctcttgccaccgtctgtcccacggtaacattcatcgaactcagatgctgataccatgtctgcattccattaccgtgattgattacgatgtaatttccacgtgcactgttgtactgtgcggtaataacggtaccggaatcagccgcataaactgctgctccgtatcctgcaccataatcgattccgtcatgaccggttgttgcacctgcagtcggtgccacacgtccgccaaagccactggtaatcgctgctcccggtaccggatgtgtaagtgatccggttcccgatgcacttgcattgctgcttgtattgcctgagccgcctgaactgcttgtgcctgacgaagctgatgcctgagctgccgccgctgcctgtgcagcctgtgcagctgccgttgcttctgcttcttttctgcgggcttctgccgcctcagctgctgcaatcagctgcttcagcttgtcagcattactgctgatctcagatgtcaggttatcgatctgaatatttttatcagcaagaagcttttctacatttgcctgttctcccgcaagttcatcctgcaggctttccagctctgcatactcttttttaagtgcattttctctgttctcgacatcttttcttgtatcttcgtattctacaagaagttcacggtcgcatttggaaatcttattgatgtattctgctttgttcagcagatctgcaatactgttagcttccatcaggatctccaggaattcattgctcccgttctcatacatatacttgatacgcagcttcatcgtctggtactggtcatcttcgttggctttcgcagttaccagctctgtctctgcatcattgatctcagtctcttttgcagtcagatctgactgtgtcttctccatctttgatacaatggaatccagttccgaagaaagttccgacttctccgcctcagccgtattcttctgctgttccagctcctgctgtttctttttcgcatccgaaatatcatcagcctgtgccggaattaccatactgaagcaaagcgtaaacgccagtaacgccccaagtatctttttccctcttatcatattcgtctcccttaaatattatgcgactagactcttaagtgctttctaatcgtaaagaaacttcccacaaaaccaattccgattcccagtaaaagtccgaccggaagcagtgtcttgtatacctgccccaccggaaggaaatccagaatattattcagcagactgaattttgtaagaatataagtaattgctctattataaagtacataaaggataccaagcggaatcgccgcaccgacaagaccgatcaggataccttcaatgataaacggtgcccgtacaaaaccatccttcgcaccgatatatttcatgattgcaatctcttcccttcggacagtaatacccattgtgaccgtattgctgatcaggaaaatggatactgccagaagaatcgcgatgataacaaccgatacataccataccagcttgttcacgctgttcagtgtattggctacggtatctgatttattaaccttgcgaaccccgtcaaggctttccgcaaaggaaaccagcttcttctgtgaagccacatctgtcatatatacttcatagttgtcagatcctgccagaggattatcatttttaaatccttctgcaaggtcacttgattcgccaaaatactgatctttaaatgtctcccatgcttcgtccgcagacacatacttgatctcttttacaccatcctgctttttaagctgtgcgccaatattatcaatctgctcctgcgttgcatcatcattaaaaaatacagtgattgccacgccttcttctgctttgtgtacaatatactggaagttcataataattgagaaaaacagtccgaacacaaagatacatgcagccatagttgcaacagatgccagtgaaaacatcttatttcttccaatattcttaactccctgtttcgcggagtatccaactgtactaatcctcatgcttatacccaccttcttgttcgtcgctgacaatgacacccttcttcatcgtaataacgcgctttttcatctcgtttacaatttcctggttgtgagtaactaccagaactgtagttcctctctcgtttgcttcttcaagaagtttcatgatctcccatgagttggttggatccagatttcctgtcggttcgtcagccagcaaaatggcaggctcatttacaacagctctggcaattgcaactctctgctgttccccaccggacaattccttcgggaacgctttgtacttctgtgccagtccgacaagtgacagagccgccggcactttctttttgatgacacgggttgatttttctgtaacccgctgtgcaaatgcaatattctcataaatattgcggtctttcagaagtctgaaatcctggaatacaacgccgattcctcttctgtactgcggaatctggcgatgtttcatacgattcagattctgaccgttgacaataatcgtacctgacgttggttcgatctccttcatcagaagacgtatcaacgtagactttccggaaccgctgtctccaactacgaatacgaactctccctgttcgatccgaaggttgataccattgagtgcagcaatacccttcgagtattccttggtaacttctttaagttctatcatatgctcctcctaattatccatactccgatataacttaatactccagtgtttccatgtatttcatatatttgactaccatcagcgcgatcttaaatgtgattgcgtcctcaaatacgcgcagatccagtcctgtgctcttctgcagtttgtcaagacggtacaccagtgtatttctgtgaatatacagctgtcttgatgtctcggaaacattcaggctgttctcaaagaacttattgatggtcgtgagcgtctcttcatcaaattcgtccggagatttcccctcaaaaatttcgcggataaacatcttgcagagcggaattggaagctgatagatcagtcgtccgattccaagcgcactatatgcaataacttccttctcgtcgaagaagatctttcctacatcgagcgcaagcttcgcttctttgtaagacttggatacttctttgatgtcattgacgatcgtaccatatgcgatacggacattctcttctccttctgctttcagaagatcaagaatctcatgtgcagtcttgtccatctccggatagccatcgccaggacctaattcttttactacgatgatgttcttctcatcaacagctgtaataaagtccttgccctttccacccagaacagaacggagactgtcaagcgcactgacatctctttcccgagaagtctcaactataaagatatcacgttttacctctgtgtcaatatgtaattttttggcgcgattataaatatccaccagaagaaggttgtcaagaagaaggtttttgatgaaattatccttgtcaaaacgctccttatatgctaccagaagattctggatctggaaggctgcaatcttgccaaccatataaacatcttcactgccgccattggcgatcagaatgtactccagctggtgttcatcataaattttgaaaaactgatacccctgaatcacctgactttctgccggagattctacaaacgaaagaacggcattctcataatctccaggctccggaaatgttgtcgccaaagtctttccatctgtatccatcactccaagatcaatccttgtaattgatttcaacccttcaatcgtattctgcagtatctgatttgatatcatattctctctcctccatcctccgtggttctatacactttgtacaatcttcatcccccgcaactgtggacttagccatatacatataatactttaatacatattaccaaaaaaataaagaggaaatcacatttttttatgcatttcctcaattgagtttattataaaatttattctatcaaaaaagattttttgattttttttattattttcagtcttttgtcgcttcaattatacttcttttcttttttgctcttttttgatctcccgttttaaaatccttttaccgataaaatttttcaggtgatctgcccagttctcaccatttgcaaaggaagcaatactatgtcctgttccaaaccacattctggtattcagctgctctttgcaccggtaaacaaactgttcctgccaagggaaatccatgctggcaatcacacagtctacttctccgccgttgaccagattggtgatcctgtcatcctcactttcgtctgccggtactgctttcataccgacaacctgaatcccactgtatgcctcatgcagatagccctgcagtctgtctccttcttcctcagatcctgccagtataaatatcttacagcggttcttatgaaaataatggaataccatcttcagcatcgtctgatcctccatctcctggatccgctttctatctgtgatctttgcagcttcaagaatcgccatatctcccggaagcagaagatccagtttctccaactcttccttcataccgtcaagctgtgtcgctctcatcagggtatccaccgtaacaatatctactgtgttaagttcttctgtctgcatatattctgcaatgatcttcatcgcatcttttgccgtacagttatcaagctgtacgtccagtacgttcattttttcattcatttgcctcacccgttccattttctcggtttttgcggtcaagcgattatatcaaacatacagtgctttttcaacaaacgttgcaaaatattcacattttttaaaatttgtaatattattgtaaattcccagtctcattcttcctggatttttttgaaatgattcctccgatccgcccggtttcttttgatgacagactcttccagccatcttccagaaccttatcgagaagtccaagctcctccgcaatctcgtattttacccgctcacttgtttccagattggggatatcttcgcgtctgattttctttgtctttgtgcttttcatacctttcaactcctttttcagagtgtttccccaattacggattttatacatttatacctggttattataaaagaagccggaaacattacttccgacttcttctccttctgccttttctttatcggcaaagctctcttattttttattctggatccggaatgataactgctgcaacaaaataggcaaccacggcagtcccacagcttacgcaagccagcaaaacacctccaagccggatcaatgtaggatcgatattaaaatattctccaagacctccacatacaccgcagatcttacggtttgttacggatctgtataatcttttctgttccataaaaattcctcctaaaagtttctcctatttttgtgtttcttctattatatatgtttcatctgatagatttttctgtctatgttaattctaatggaaacggatctccacgctgcctgctccgttcgatatctcaatcgtgcgtttactgccattatcgattgacttctctgtgcttaagccgccaagatctatatcttctccaatttctatcgaaccggcactactatccagttcataattataatcctccacttttccttccagattcagtgtgacgcttccagcaccacagtcaatgtccacttctttttccactgttccataaaaatccagacttccggcacctgtttctacatctaactcctctatatctgcattttttattgtacagcctgatgccccgctttcaatcttaaggcttttcgcatttagtccatcgatctctgctgttactgcaccatattccatgtccacctgatcgaacttgtaatctcttggaagatagatcacaagtattccctttacgtttctcacatttttgaaatcgaaactgctgcgcattttcattgttatttccagagttttcctgtcatcggacagtcttttctgcactgcattttccgttttcatcctggaatcatccacatggatcttatcatccgtccccgtcttgatctgtacctcacttgcaccgatatcaagcttcagattctctacgttcgaaaatgtctcctctgatacaacattttctgtctcttccggctcatcatcgtcgtcatcatcatcccaatcttcctcgaaagaaacgtaatcctttcttataataccaattccattcggatatgctttttcaaactgtgaaaatgtgactccaagacataacgcaatgatacaaaatacaactcctgcccctgtcaggcttataataactgtccagaaaatcttccatccttttttcatctgcattcacctctctttttctgaaatggtatgcgacaaagatttacaaatccacggaacatcattggaatcagtttgatgcatccccatccgatcaatactgtaaatactgccccaagtgccagcagcaggcagccgacaccaagcattccgattccaagagccggggaataaaacagctgaccaaatccgtgaatccccaacagaatccctacggctgcggttgcaactgctgccacccagatcgctattgctgatattgcaagtacgaccagaactccaaatgccgccaaaagaagaccaagtgctgtcggaactacaattggaagcccaatcaaaaggatacagatgatcaaaatgatcttgccggcactggatttcttccgtggcatttctgtcgtctgacccgcaccatatccctgatttcccgcatatgtatatccctgattagaattggctgtataagaatactgtctttctgaaaatggattcctgtcattctgtgactggctttctccacatgtctccgaatagctgtctttataatagccatcttttcccgccggatactcactggtatcaaaacgtctgtcctgatatcctctctctccgtactctccataactttccgcctcatcggtattgccatttatcccggcacggatcgtttctgcaagctttgcaggacttcccagctcttcgattactttttcttcattctcgcttccggcgtcatcaaaataatcgttgtaatactgcattgcttcttctctttcttctttcgaaattccttgaagcagtgcatctaattccctcatatactctgtacggctcattcggctgcacctccctcgaacatctctgtaatcttccttgtgtagttcttccattcgactttatacaaattaagctgtgccattcctttttctgtaactttatagtatctgcggtttcttccgtcaaactgcatatcgtagacttccaggcattcatctttctgaagtcttctgagtaccgggtacatcgttgattccgatacatccaaaactctccggacatcctgtgtgatcttatatccataggttccttcctgttcccgtgatacaacggcaagcacgattgcatcaaggagggcagctccggtgttaaataccatatgattcacatccttttattgtttgttatattgttttgttaagcatattatacgttatataatatagtgagtcaatataatattgtataagactttctgaagatttcctaaagaaatgggtgggagacggatggtgagagggagggtgtgacagcttgcagatagaaataaagtccccctcttcccacggggcgaaggcattccgatgagcctctgaatgcgaacattgtgtcagcaatggcttccacaatgtttgagtctcatctccattgcccctcaagggaagtggtggactttatttctatctgcaagccgctcaaggttatcgaatgaccaaccatccgcttgggcgggctgccagggctgatgctggggcgaaatttgaaggattgtgaaaaggggacacacagcgcctgtaaggcgactgtgctgggggatcaaatattttaaatataggggtaaagaaaatatgtaattactatttgaatgattagaataatagggattcctaatttgaatttcaggtggcgggttttgtggtggtagtgtttcatggcgaggagggcggctggggagccgcccagaagggccaggaggatgagggtgcgttcggggattcgccatttgttttggcgggctttggttttatcggcggcgtaggtgaagtaggtgatgatgttgatcaatagcaggtatgcaaggagtattattttaatcatttttgtagtcctccaggtggatttctttgcgaagggtgaaggagtagatgatctgttcttttacttttttccggatgatctgttcaagggctttggtgtaaaggcggagctgttcccggtagcggtcttttagttcggcttcggtttgtacacggtcggttttataatcgagtacgatgatttctccgtcttcttcaaagtaagcatcaataattccctggatcagtaccatttcaccctttttctgatccggataaaattcttttgcatctacaccgagaacaaacggctgctcgcggtaaagtgtttttgccctggctgcattttgcattctttttcccacattcgtattaagaaactccataatttcttttttttgaatacacccggctgttcccgcatccaggtatccttcgtttttcagattctctatgttttcccgcagtaaatccatcgtatatattttcgaaaaatcaagaagctccattactttatgataagctgttccttttgttgctccttttacctcttcttcctctttcataaaattcggaaggattggaacaatctcctcttccggaatcagtatttctccatcttcttccgaagctgccgcatattttttcagctctgacacggtgtacttcattttcatctgatcttcaccctgatacggatatctgtaggaaaatgcttcctcgatttttgcccgaaaacgttcatccgtcacagccatcggatgttcttctgcttctattttttcaaggaacacctctttttccagataatctgctgcttccttatccacttcaccttctacaagcgtatcaacaccaatcacttttaattcgattggaacttcttctgttttacgcactgccgccggaaggatccagtcataataagacgttgcacgtgcaagttttgtaaagtccagtgtttctttctgactgttttcctgttccagctgacaggcttccagcttgtctgccgcatgtggaaccgttccggtaagaatcagcttttcctttgcacgtgtaagcgctacataaagcacacgaagctcctcaccaagattttccagaccgatttcattttgaataactttctttaatagtgtcggagatttggttcgccgctccagatcgatcgcatcgattccaagccccagatccggatggatcacaacgcttgccgtggtatcctgaatgttgaacctctttcccattccggtcacgatcacaaccgggaattccagtcctttactcttatggatactcatcagacgaactgcatccgtctgctcatcgtaaagcccggcttccccaaagtctacattatatttcttgagctgatcaatataacggacaaaatgatacagtcccttatagctggttgcctcaaatgcctttgccctggtgatcagcatatcaagattcgcgcgccttccttttcctcctggcattgccgcgatataatcccggtatcctgtctttttcatgatctcccacaggagatcatggattgccgtgtacggtatcctctcccggaaataaaagagccatccaaatacatcgcgcacttttttcagaatgcccgccggaagatctgtctttttttccggatccgctgtttccagcacattctgataaaatggtacttctgcattcaattctctgatctgtgccagttcttcatttgtcattcttccaaacggggatttcagcactgcaacgagtggaatgtcctgacgaaaattgtcaagtacacgcagatagtccatcatccatccaatttccagagtttcaaaatacccatctgccgattcagccagaaccggtattccctcatcctgcaaaattcgtgtaacagtatcggtccaccctgcagggcttcttgtcaggattacaatatcctgatagcgtatcggtcgcaacattcccgtttctttatctacaatctgctgattttccatcagctctccgattctttgtgcgatcagacggacttccagctcttttgccgtctggcttccgcttcgcacagaaagcccggtatcctcttcctcactttttgtatccagaagaagaatttctgtctcattcttttcggattccgggtaagaagctcccacataaagtgcagcattctcatcgtatgtgatccttccaagctcttcggtcatgatctgtcggaaaatgaagtttaccgcatccagcacttctgcccggcttcggaaatttttgtgcagatcgattcgcctgtttcctccgtccgtcagactgtaggtattgaatttttccatgaaaagctccggccttgacaagcggaaacggtaaatactctgcttcacatctcctaccatgaagagattattttcccctctgctgatccgggacacactggtcaggatcgcctcctggatcaggttactgtcctgatattcatcgatcattacttcctcaaatgtattctgatactccttggccacctcagaaggcactctttttccgttttcttttcttgtcaggatctgcaaggcaaactgttccatatcccggaaatcgatcagatttttttctgccttcttagctgcaagtaccctctggtattcttttaccagactgaccagctcatgcatcaccggaatgcagattttccggtctgcttccatctcagatggcggctggaaaaaataattgtttcgaatgtcatcgataagtttcttccaggtatcccgataggctcttacctgctctctttttgtcggatctactgcgtcatctttctttctggacagagttttccatgccggcttttctttcagtgcctcatacatttcttcatagctctttgccgcaaaaagctttctcagaactttctgatccgcttccagcatatctccatacatatacggtccgtccggttccatgcagatctggtccgctttttccatcaacatctgcatatccgcaactgttctccggatatactccatcaccttttcaatataaatggctttttccccgctctcttcgtacatccttgcacagtcatccagccactcctccggatccggataacttccggcaaattcatacagtctgctgatgatttcttccacctgcagatcttcccttccggttgcaaaagtctccacaaaacgcaggaaatcctcgtttccttcttcatattttgcttccagaagctctttcatcacgtcctgcttcaaaagctttaattctccttcttccgcaatacggaatccaggatccagatcgatcgtgtgaaaatactcccggatcacagacaggcagaagctgtggatcgttgtaatctttgctgtatggatcagggcagactgccgcttcagatgttcacttgacggatcctcctccagctccttctcaatcgcaacaccgatcctttctttcatctcagcagccgccgcctcagtgtaggtcacgatcagcatatggtcgacatccaccggatttgcatcccttgtcagcctcgcaataatccgctccaccagaacagcagttttcccggagccagcggctgctgacaccagaatattatgatcgcgcaggtcgatcacctgctgctgttcttcggtccattttactcccatgtctgcttctcctcttccagcttcgccataattttctccattacaatttccttcggaagcttctcaagcttccggtattcatatccttcgatctgctcatcaaatccgcagatatcccggtatgggcaatacgtacagccattttgtgtacccatctcatacggcagtgcctccgcctttccgcggtacattgctccctgaagatcagtccgtcttttctgtgcataagtcagcactgcatcaaactcttccggcaggagcattttggatgctttggaatagccgcttttcgtctttcctgccggaatcacaagcgaattccccgaaaaatccgcatccagtctctgaatcacggcatcctcctgacggatgattccatccagccgaagctcctttaaaattgcctcttccagtttttcttcatccagctctttcccgacgatcggatccttcatccgatagtagaaaatgcctgccggcacaatctttttacccggatgttttctttcctccagccggactgcttcttccatatacaccactagctgcatctgcagaccatgataaaaagctgccatatcaaaactctttgccccggttttataatccaggatcttcacatagacctgatcttccgtctcacatgtatcgatcctgtcaatctttccgcttccaaagcttacctcacagccctccggtttaaagcttcccttccgaagctgctttgtcatcgcccagaccgtccggttcatcatacgtttcatacgtggcacgatatacgcgttccgcgcactgctgtagattacggtattgctgtaatctacgatactctcatccacgctttccgacgcaaactgttcctgctgctcctttgtaacctcagtccattccaggccttcccgttctacccgtcgggcatatttttccagtgctttatgaaaaatatttccaaaatcaagagcagcaaattcatagacctctctctccttaaggcgaagtccataggtcagaaaatgcgcacaggcacaggcagcaaatttctccagtcttgaaatgcttggtgcccagtctccataaagcttccgtgcggtctgcaaagtcagattgtcctccggcctgcggtatctgctgatccttgccagatcgtgcaccttttcgttccagtcctcctgcgcacaataccaacggtacagctcctgccagctgccttcctccatctttttcgggttctgtaatccttcgatcaatgacccgatcccggtctgtggaagcatttcttttgtctccatcccatactgatccatattaaatacaggaagctttgtatacatccgcttcagatccccgatcagatatgccgccctcctgctctttccatcggccgatactttactgtaggtcagcatcaattcttccgtcggctttgtcatgtgcagatacagataaaatttctggatgtaacttttttctcttgttcccggtgcaagcgcaattcctctttcttcaaaacgctcccggtctctgtctgaaatcagtccacctgcggatgcatttcccggaatcagagaatcattgactcccagaaggatcagcgcccggatatctttcagtctcgttcgctcaatatctcctgccatcacttcatccagacttggcggaattacaccgatccttgcctcttccattccggcatccagaagctccctgtactctttgagcgcaatccgctcatctccaagaagacttacaaacttgtcaaacagctccatcaccacacgatagatctgtgcatattcttttgcaagtgcaagctctcctgcttctgtaaattgattctccaatacttttacctgcttctggatttcttctttttccagaaattcacagattgcaagcgtcacatcccgcactgtcttctgacgctgctttaagacaaacaccagctcttctgttttttccacaaagcatacccggagatgattcagtacctccaactcttcctcggtcgtatccttcgctctgcggatccatttttcctgccattttttgtaaccacggatgcccagcgcaagtacataattttccagaagatccaattcctcaccggtaaatccgaccagatccgttcttaagaaacggaacacactttctgcagaaaaattctgttctgccatcgcaagaagactccggatatactccacaaatgaatttaaaagtacattccgcttataatccatgaaaaccggaatctcatactcccggaaagtcttctcgatctcatccgcatagagattcatgtcacttgcgatcaccgcgatctcccggtaacgatattctttcttacgaattaaaaaacgtatcctctgggcagcgcattctacttccatcctgggatttgccgctgcataaacccgcacatttgactgcttttccctgtaagtcctgccactgtaacggaacagttccttctccagaaatgcaagtgccggcgcatttctaaaacgccagaccggctcctggtacagacagaccggctcttcgaccagcaccttttcctcccctgcaatcttcacaagagacgtcaccatctgcttactcagcgcaaacagctgatacttgtctttcatcacgtaaggatcttccctcttatccatcgtgacagtaatcatcaccttctgacaatgatgcagcatttcccccagtaccttgttctgaagcggcgtaaatccggtaaacccatccagcgcgatcacactgtccttcagcattctcgatttgtccatcacattgcagagaatgtccagaatttcttcttttgtaatatatttatctgcaagatattcttcaaatgcctgatacatcacctggatatccttcaatttccaggcaagatacgaagactcatctgcctccgtgatcatatcatccatgccatccggggaaatgttgtactgcgtcagctcggaaataacggatttcacctcactgatgtaacctggctttttgatatttccttttaaaacctttagcgaatcttcttttttccccgcgagtcgcctgagaatcagattctttccttcatcatccagaatctccctgcttccattccctgtttcttccagaacacgaaaagcaagacgtgcaaaactcagcacgtctatgttcataattccatgtctcggatgccgcaggaccagttccttctgcgtctgcatcgtgaactgttccggcaccagaataatataattaatatcaggatgtttcattgattcccgaatgatatgttcatatagataatgtgacttgcccgaacccggatttccaaaaataaactgtaaagccatctgttataccctcccgtcaagctctttcggcacgtatgcagatacatggattccatcttctttgtattcttcctccagcagttctccatacttccggatgagctggattttcccggattcctgataggaataaactcgttcgatataaattttctgctcccgcaggatctcttctattgcctgaagaagcgcctccagaccttctccggtctttgcagacacctgtacgatccggtctgccttaaagtcacgtaccgtcaggctttccccgatcctgtccatcttgttaaatgccgtgaccaccggtttgtccattgcctccagacgctgcagtgtctcatacaccacatacatctgctcatccatctgtggattggatgcatcgactacatgcaggatcagatccgcatacttcgcttcttccagcgtacttttaaatgcatcgatcagatgatgaggcaacttccggataaagcctaccgtatctgtcagaagaatctcctgcccacttggcagcttccggcttcttgtcgtcggatcaagagttgcaaaaagctgatcctcctgcagcacaccggctccggtcagtgtgttgagaagcgtggactttccggcattggtataaccgacaattgccacgaccgggatccggttcttcgtccgctgttcgcgtgtcagttcccggtgtctcttcacctccctgagttcacggttcagctgtgcgatccggttcttgatgagtctccgatccatctccagcttcttttctcccggtcctctggttccgattccacctcccagacgtgacatcgcccttcctgccccagtaagctgtgactgccggtacttaagctgtgccagttctacctggatctttccttcacttgtagaagcccgtcctgcaaaaatatccagaatgaccatcgtccggtccattaccttcacatccagaatatccgtcagattgttcatctgtgccggagacagctcatcatcacagacgatcccggttgcgtcaagctcccacaaaagctcccggatttcctcaatcttgccttttccgacataagttcccggatggacaagctctcttttctggattacccgtccgaccgcttccgcacctgcgatcttcaccagatcctttaactcatccagagaatcttccgtgtcatcgttctcccttgtactgacaccgaccagaattaccctttccttttcttcttttatttcataaagtgccatattattctcccctgccagatttctttccgtcccggatcagatctgctcatccgatccgctctactgctgatctccttccgaaatctgtgtatttaaaaattcctgctctttcagcgcttttttgtcatctggatttgctttcagataactgtccagcttctcttttgcagactggtaatcccctgctttttcataggcaactaccagattatatgccatttcttttagcagctcttttcctgcgcctgaaagctcctgcccattttcgaaataatacactgccttttccggtttatccagttccagatcgcagattcccagaatattataaagagttgctgtctcttccgttccattcttcaatgctttttccaacaccttctctgccttttcatactttttctgttcccagtagcagagtccgagtccgcgataagcctctcccagattcttctttttgtctaccgcatcctggaattccacctctgcatttttataatctttttcttccagatacttcgttcctttttttacagaaccagcacatcccgttactgtcatacaaagtgctacaaggatccctatgattacctttttctttcttcctgctgtcactgttatcgtttccttccttctatattgatatatcatctgttattccagaatatgctccattccctggttcatgatggtctggatatgatcatcagcaagggaatagaacaccgtttttccttcccgtctgttcttcacaagcttcatctgcttgagcatccggagctgatgggaaatcgcggactgcgtcattccaagaacttccgccagatcacaaacacacatctcagactgaaaaagaacacataaaatccggatccgcgtggtatctgcaaataccttgaaaaaatcagcaagatccttcaaaacctcttcatccggtatatgcccctctgccttatgtacaagttcttcgtgtatacaaaatgtatcacaacattctacttctgtctttttcatagttacccctttcatatgaacaagtattcatatatctattatgccaaatgatctctttacggtcaactgtttccattgattccggcatgcaaagtaaaaaagaagttactgttcactccccaatgtcatttagttaagttacagggttagcccctaattgtgggtctaacccaaattttttcaaaaaagctacccaaagggttgacatagggtgcaaaatgtgcggccgctctcgctactgataaatttgttgaggtagcgagagcggcccttgaattagtggtatatcactttctcaaggaggcacatgatcatgatccatcaacaaatcaaagaactgtttttttcttctgtggaacacattgtttctgatatttcacagtatgctgtccatcccgattccgatttcaagagaagcaaaaaaatccctgcccagaaacttatttcctttctcgtttcacaaggctcatcttccaccagggttgaaatgcttgatttctggggactggattcttccataccaaccgcttctgctctcagccagcagcgcgcaaagcttaaacctgatgcgctggaagctgtattccggcactttaattccgcttccatggaattgccgcccgcttcctttatggattcgcattaccgtttcctggctgccgatggctctacctgcacttttttcagcactccggctttctcatcaccagactactactgttgcccggcacgatgttttggatggaataaaaaatgtctatatcggtgaccgcggctattgctcttataataacatggcacatgttgtggaacagggacagtatttcctgttccgtaccaaggatatccattccaaaggactggtcggcaattttaattttccagatgcggaatccttcgatattgatgtcagcgtcatactggtccggagccattcgaaaaaagttttggcagacatccacacagaaggttacatacgctttgttgatcaggcagctgctttcgattacattgaatatggaagttatgatacatatgagctgtccttccgtattctacgcttccctatcagcacttctacatacgagtgcatcgtgaccaatctgccacgtgatgaattccctgtggaacgtatcaaaaccttgtacaatgccagatgaaacattgaatcctcattcaggaaactgaaatataccattgggctgagtaatttccatgcatataaacccgaatacgtgaaacaggaaatatgggcaaggctacttgcatcattataatccgttttgaggcagatttgcaatctgtctttttgtcgtgctttccttcatgagtaaatcgtaaacatatctgtaaaactgttccactaaggcccatctgtaatttgttctgtaagaattcgctccctattaaacgttaactaaatgacattggttcagtaccctcacaattacgcgcaaaaatccattccaaatcagctgctccgataggatttttgccttccagcctaatttttcttacggtcagcgcagtaaatgcgcagacctactgaacagttataattattctatataatacagaaaatttttacatatgacaatgggaaaatataggaccttttatacaatatatccaaaaacattagctaaaatccttcctctttcctttacttttctcctgttccatgctatgatagcgatagaatatttcagttatatccgaaaaaatttttcgtaaattcaggaggaaatgtaaatgaaaacacttggctactacaacggtaaattcggacctctggaagagatgaccgttccgatgaacgaccgcgcatgttatttcggtgatggtgtgtacgaggcgacactggcgagaaacggaaagatcttcgctttaaaagagcacctggaccgtttcttcaacagcgccggactcattaagatcgatatcccttacacaaaggacgagcttgcggcgatcctctacgatatgctggcaaaaatggacgataaggatatcttcatctactggcagatgacccggggaaccggcatccgtcagcaccagttcccagctgcaggcacaaagccgaatctctggattttcatgaagcctgggaaatcggctgactccagcaaacgtctgaaacttacagacatggaagacacccgtttcctccactgcaatatcaagacattaaaccttctcgtcaacgtcatggcggcagagaaagcggagtctctcggatgcggcgagtgcgtcttccaccgcggtgatatcgtcaccgagtgtgcccacagcaacgtttccatcatcaaggacggcgtatttaagacccacccggcagaccactatattttaccgggaatcacaagaatgcacatcatccagatctgcaaggataacgggatcatcgtcgacgagacaccttttaccatggcagagctgatggatgccgacgagatcatcgtctccagctccacaaaattctgctccccggtctgcgagatgaacggcaccccaatcggaggaaaggcaccggagttagtggatttgatccagaaaaagtatacagaaaaatttgaaaatgagaccatgtaaatgatcagaagggctgtcgcattagctaatgcgacagccccccatttttatccgtaactgttcagtacccaatgtcatttagttaagttacagggttagcccctaattgtgggtctaacccaaattttttcaaaaaagctacccaaagggttaacatagggtgcaaaatgtgcggccgctctcgctactgataaatttgttgaggtagcgagagcggcccttgaattagtggtatatcactttctcaaggaggcacatgatcatgatccatcaacaaatcaaagaactgtttttttcttctgtggaacacattgtttctgatatttcacagtatgctgtccatcccgattccgatttcaagagaagcaaaaaaatccctgcccagaaacttatttcctttctcgtttcacaaggctcatcttccaccagggttgaaatgttttatccccaattaggtgtaaaactctgctcgatggcgggcggcggcgtacaaaaaatctatatggtgtttttaagagaaccgtcccggcgggacaggtcaggcagtgacctgttccacctccgggatgggtttgagattaaaatgaatttcgatagaaatgtgtcttgttttatcttcgtcaatgcgctcatgcacgacgatttctttgattaagcggttgagggtggctgcgtccaactctgtgatgttggcatattcctgaatggcttccacccattgttttgcgtcattggcaagctggacttcatcggacagccgctttctgccctcggacacttttgttttaagttccgtctgctcggtctgtgtcttttccagcatggtgttgaagttctgctcactgatacgccctgcaatcatatcttcataaagccgcattaccattttgtccagaacctcaatccgttcctcgtcccttgtaagggagcgttccattgcttcccgctgttcccgctgctcggcttcacaggtattggtcaggcggtcagcaaccgctttcccgtccatcagggcagctctggcacattcccggattttccgcagcacatgactgtaaagggtgtcataatcaatccggtgctgggtgcagtggttctttccaaaggcattgtaggtcttgcaggagtaaatctgctggggatgttttgcgtttgtgtagcgtaccgtcagagacttcccacactcgccgcattttatcagtccggcaaacaggctgatttcattggtctgccccggacgctggcgggatttcagcttgttctgcacaatgtcaaagctcatgcggtcaatcagcggttcatgctgtccttccactacaatccagtcctccggcttcttttccccaatcgtgccgattttgaaacggtagtcctttttctgggaagcaatcgccccagtgtaaacgggattcatcaaaaggtctttgataacggaaaagtcccacatataccgcccgttttccgggtctttcttttcccatttggtgcgggtattgcgaagcccccgttcccggttccaccatgtggggcaggggattttttcttcctccagccgtctgcggatatagttcggaccatgaccgtttagggcatatccgaaaatcagccgcacaatcggggcggtttcctcgtcaatgagcagatggtttttgtcctccgggtctttccgatacccaaacggggcaagacacccggtaaactgtcctttctgcgctttcagaagataagaggaatggactttcttggaaatatccttgctgtacatctcgttcaggatattcttgaacggggcgatgtcgttgttatcccgcagggtgtcgataccgtcattcatggcgatatagcggacaccgtttcttgggaaaaagtcctcaatcaaatgccctgtttgcaaatagttacgccccagtcggctgaggtctttcgtgatgacaaggttgatttgcctgcgctcaatggctctcaacattctctgtaaatcaggacgctccatattaagacctgtgaagccatcgtcctgatagactgccacaacctcccatccctgcttttcgcagtatttttccagcatatcacgctggtttgcgatactggcactttcgccttgcaggtcatcgtcctttgacagcctgcaatagaccgccgcacgatagcccccggcaagtgctgaaccgattgttctgtattccatttcgttcatcatagccatttacccacacaatccagacggtatctggctctgttgaacctcatcttcattatacttcaaatctttctttttagcaagatattcttttgtatttgttttgccgtatttctgggaaatcaggctgacgaacacatcggtggcgtccagttccccgtcaaatacggttgtcacttcaatcttggtcttatttttcgccataggcagttatcctccatacatgaaaatagccagacagagaacggtcggcaacgaagtccggcaacgggcttcaaaagaccttgcaaacaatctcaatctggcgttgattactatttatacttttcttttatttttctgttgttttggttgtcagagagggaaaaagcccggaaataagggattttccccggcaaccggctcggcaacgggatagcaacgaagtcggcaacgggctgtcattttcagaatggaagctccatctgctctgtgacctccacaaaaccgtccatagatttttcgggcgggttgtcggtgtccgttgccgggatttcacgctcccagcccttttgtctgccgtattccgcaaacatcctcggattggaaaagtagttccacccggtaatgcactggttcattatctcgttgatttcccggatttcccattgcttcggctcatcaaaggtgtggtttaaggcttccttgtagagctgcttggagcagaccgtttccccggtgtacttatcaaggtaagcctgtatcatcccggctttggtgtcctccggcataaaatcccgctggtgttctttgagataccgctgcatggctgggctgaatgacagcttgaacatgccgcttcggtaaatctccattgcttccgcccacatctggctgatataggctctggaagcggcttcgtcctccaaaatgtgaacctcggcttgctccgggtacaccatgaccgggataaatcggcggttgccggaacggtcaagggggagaaagtcaagggcgttggaagtgccgccgaacacgcattgacgggggcggtctgccgggtgagtttcatagggaattttgtaaacctctttctggcggcttagaaaggacttgatttcctcaatgctcttggcattggcggttgccatcatttccgacatttcaattatccagtgaccttgcagcttgcggtacacgttatcatcgtccagcttccgcaaatcatcggaaaaccactcgtcccggactgccagcagccggaagaaggtggatttgccagccccctgaccgcctaccagacacagcatgatttcaaacttgcttccgggcttaaatgcccttgtaatcgcccccagcatgaacagcttcaaggcttcataggtgtaatcgtccacatcagctcccagaaagtgccgcagacagaagcggatgcgctcagtcccgtcccatgcaaggctgttcagaaaatcccggatggggtggtacttattctcattcgccacaatcccgatggcggtttcaatctttttctcactggtaagcccgtaggtttcctccagatagagaagcagatacttcatgtccgtatcggtcagggctgtgctttctctgtgaaaaccgatgggctttatgatgtccttgcggtcggtcaggatgttgtaggcgattgccccggcaagcacagggtcacgctggaatacggtcaggcagttccgtatgctctggcggacgccgcctttctcggtggtttccagagttgcctttacttcctcaacgctctggggcggctgcatggcgttcatggtgttttttagttcttgctgcgtctgcggctgcaagctctgccattcgctgttcaagctgtatcacatcctttccgtagtccataatcaaaaccgctttttcctctgtctccccgaacagcagcacatccagcagatattccacatgggcttgcttctgcaaggcttccacgaaccggggatgaaacgcttcctccggggagtgcggggcatagtcggttttccatacccgtaagaggtgtagataatcggcaaggacacggaagcaatgtgcctttgcttcccggaactgttcttccggggatttctgccggggcttgggcttccttgccctgcccggtggcttccagtcctcataggcaagcccgaagtcactcgccaactgtgcggcggcttcctttttccccagcccgtacagggcagctacaaaatcaatcacatccccatctgcaccacatccgaagcagtggaaacgcttgtccagcttcatgctgggggtcttatcgttgtggaacgggcagcaagccatcccgtttctgtttacccggattccgtaatgctccgcagcctgtcttgtcgtaacggactgcttcacagcttcaaatacattcaaatcaattcctccttgtaaaaaagaaaaggcacttatcattctcaatctgaaaatggcaagtgcctgttaaagttccatatcctgttgtttgtgtttcgtctgcgccggggcgtttttctgtgctttcttctcgtcagccttatcctgcaagacttctttgaggggctgcttcttgggcggctctttgctttcctctgtgccgggtgtggctttccgtacccagtagcggatgtcccgcagcttcttcaaatcttcctgcacctcggtcaacggtactttcaagtctgcgatttcgcccacaagcttcgcctgttcctgcaaaagctcctttttcgtgctgtccttatcatccgggtgcttggcaaggtaggcactggctttctcaaaccgggcaacctccgggtgttccagcttgaatttttccttagttttcttgaaaaatatcttctggtatttctcataaacgggcttacattccttacagtccgtccgggcggcaaggatagcgtcaatcacgttgctgcgggtttcctttggcttcatctgctttcggtagtcggcggcagatttcccggacgtttctataaagttttccaaatcctccacggtggaaagtccctttctctgaagataggacagggcttcgctgactgcctttaagtctttggaagttccacggttttgtcccgcccgtgtccagtcgctccgttctgcctttcgtaactccatgtacttcatcaacagattgggaagaaataccgcttcctccgcagctttttccgcaagcagttcttttcgtttttcactaagctcgataatccagcctttgagatttttaataagctgccggatagacttcatcaggctgttggcggctttgatttcccggttcagatttccgatgttggtctgaatccctcgcttttccatctgccggacagcagcaccctcatggacggtagggataatatcaagcccctgtctttcataagaacggagatccacccgctccgggcggttgttggcttccagatagcggttctggatgatctcccattcatgccgccagatttcacaatacttgcggtcgttccagtcaaccgtatcttccttgtgacttttccatctgccggacggaagttttatccgttccccgttctcgtcaaggtcataaaccttgcggctcttgggaagccatttcccatgttcatccattgcccgcatagtcagcatgacatgagcgtgagggtttccgtcccctttgtcatggatggcaaaatccacgcacattcctttggaaacaaactgctgattgcagaaatcccggacaagggcggcgtactggtcgggcggtatctctctgggaatggaaagcacccaccgccttgcaagctgggagttccattgcttctcaacagcttcggcggcgttccataaggtattgcggtctgcatactctggcggggcatttgccgggagcaggatttcattatggacgataccacgcttttctgggtagtgcttcacttgctggtcgtattcacagaacagcttttcgccgctttggtaagcagcggcggcaacagcagactggcggttgctacgctggacgatggagatttgattgtgtggacagggcatttagtgttcctcctttccgattttaggtataaaaaaagcaggagacctttttcagatttcctgcttggtgtgccgctgggggcggcgggtatttagttaaaattcaagattacttaactttataatagttttctattgcctgtgcaaagaaatcagaagccccttcaccgtatttttcgtctatcattggtttgatttgttcattgcggtaatactgcgcctgtgccatcataaagcctttttcttcttttatctgggcaagctgtttcataacaaagccatattctccaacaagctcttttacttcaaaagaatctatgtcacaattctgttttgcaatcagtttttgcaaaatcgcttctatccgtttgttatagctttctgcaacttctttgctgacgggagttcgggcaacagacagaaacttgtcctttccaccataccattcaactacctttgcatagcctttctgcatttcttccgaagatacgacttccatataatgctttttccattgttcaatgctaccaaattctttaattgcaatgtttctcatattctccggcatatgctcaagcatggtttggaacatttcttctacttctgttttggtaaaaattgtaaaatctattttgttctctcctttcagaatgtcatcaatgctggcaatcagacgttccattcgttctttctttgttaccaacatttttcgctgtacttgtagaatctgatttctttcaagagccggattgtccaaaacagctttgatttctttcaaggagatatcaaactcacggaaaaataaaatctgttgtaatgtttccagtgccttatcgtcataaagccggtatcccgcatcacttttttctgttggctttaacaacccgatttcatcataatagtgaagcgtgcgaacgctgatacctgttaaatctgatatttcttttactgtcctcatagctgctgacctcctgttcctgataaggtaactttaatctatgacgttccgtgagagtcaataggcattttcattttttagtataacatttttcatttcttctcaaaagacagaaaactgattctgtaaaacttgtcggctgggaacagcttgcaacgcaaggtgtccccagatggcaagtccacaaaagggtagctggcgaaagccagcgcaggggaagtgtagcgtcccctgtttgatttggagcagaccgtggctgcggaaaattacagccctccggcgaggagccttcggagaacgcaatgcaccaacctttgggtggtgtataattgcgcccttagtaaactaaggggtttccggcttctcccgttccagcagttttttcaatagttcctgcgtgtcctgcctgtgaaaaatgagtttcaacagcagcatgacatcatcatctgtcaggcgttccggctcttgcagaaaactttccagcataccgccacgagtacagagccggtgcgtccgttcctttctggtaagctgcttcaactggtgctgcaatgccttttcatcattgatggctttccgcagtttcttttcgcttttttccaactcccggttgagcttttccagttttgaggtatcaggcaagggcagcgtcctcctttcccggtatcagcacataaatcctgtttggttctccaatgccctgacgcacccgcatgataagtccggcggtttccagttcattcagagaacgcttgaccgtcatggggctgcgggacaggactgcggcaatggctgtgatggggaagcagacaaacaggattccgttctcgtcctccttccctttggatagcatagcgtccagcatccggcagtacatgacctttgcggtgctgctgactggaaatcctgtcaacgctctgggaaatggcatacagggcggtaatggtgtgtctatcgtcataaattcaaaattcattcggtgtgttcctcctttttctttgctcgtttggataaataacgggggcagtcaatcacaaccgcccggaagctctgcttgcacccatgctggcatttccggcataattcgttgtaagtgacacgcccccggtcattgaggtaaaaggaaagctcatgcttcctctttttgctcattctcggcatattgtgtttcctcccgttttagtgtatggtttcgggggcgattttcggcaaaattacagccatagagccgcttaaaatctcccgaagtatcagcgatagggtagactatccccctatcagattgtcgtgtttcggtatcatttcggtgtcagttcgccagttctccccggtgtcgttcctcccctgaatctcacagcggcgtatcgctccctttggtacgctcgtttcggtcagggttcctccatatccctgccaaaattcatggcgctacatcgccggggaagcatatcccacacaggctggtcattcgattggaataatccatcgatgaactacctgtatcatagaacatttttgtgccctgtgccgtatgtccacaaagtaggaattaagggtaaaaattagaaatttccacgattacggaaagtgtgatataatccagataagcggcagcaatgaaaccgttggaaaggagcgtgtgcccatgaaaggagcaacaagcatacaggaacgcctttgggaactccgcaaggacaaaggcttaaatctggaagaactatcaaaactaacgggtatttctaaatcagcccttggcagttatgaaaaagaagattttaaggaaatcaatcatggcaaccttatcacgctggcagacttctatggggtttccgtcgattatctgctgtgccggacagagaacagggagcagatcaacacgccactgacggagctgcatttgaacgatgaaatggttgcacttctgaaaagcggtcggatcaacaaccgtctgctctgcgaacttgccacccataaggactttatcaagtttcttgcggacattgagatttatgtggatgggattgccaccatgcagattcaaaacctcaacacccttgtcgatactgtccgacatgaaatcatagaacggtatcgccctggcgaagatgacccacatttgaaagtgctgcaagccgcccatatcagtgatgatgaatatttcagccacatggttctggatgacctaaacctgattatccgggatattcgggaaacccataaaaaggatagtgagagtgcgccccagaccactgttgccaatgaactgaaagaaaatctggaagcggtcgaaaatttcaagggcagccgtttggaaaaactggcagtgctttactgcaagcagctcggtatcaactataaaaatctgtcagatgaagaatttcgctggcttattcggattctccaaaaatcaaagaaaacgggaacgcctatcaaccagaggaaaaaacggtaaaggaaaaccgctgttgcatggtttgttggattccatgtagcagcggtttgtgctgtggttattacttcattcgttttcttaatattcggcgataatttgtttctccctttggtgcgtcctgtataatttccaacacaccatcttcaagcattttatcaatgcgattggaaatccatacatcactaattccaagttgatattttcctaaaacattacctatgacaatagccattttgaattgctctggctgttccgcaatttcacgaagaatgaaactatcatatatatcttctgaaacgctttgcaatttaccatttaacattgcacgcaaaggtgcattttcattttgaagttgattccatttcatagcacaagctgaaagaaatacaggattagctttctcttgtagagttatatagtttccccattcgccaggagagacctcgccccatgctattttggatgtcatagtattttcttttccatattcccatgtaggtaacttaaccaaataaattgttgtctggcagtttaagggttgaagttgtttcataagccaatacataccacaaagctcatctggattatagctataccaaatgcgaatttcttccccagctacatatcgttcaatcactgaggtcaatgtagttttaattttctgtattttttcttcaacctgataatctaaatcctctacaaagcagacagacagcattttcttgaaaacatttttccgctgttcgccaattccattatcagaaatatctcccacactaagagccatatcaaaacaataaacatcacagctcttgcctcccaatggaatagcattctcccaagcaatgcgttcttgttcctgtgcttgaagctgtgcttttttcatttcatctgaagatggaacactcccgtcttcatgcctcataaatattgaaacagcacttcctctatactttcccttgccgtaagtttgggcaattttcaaacttccacaggcactttcaccaaatacaatttcaatcatcttatatacctccgatttaattgctcccgttatgaataaatcatctcatgcaaaacaatttcttctgcccggttatgaatgttattgcaacgctgcacccattccatttggtgggtacgcttcaattcctcggttacgccctcggcagttttcatctgctccatgatggtgtctaaccgttcctgtgcctgttcgttcaggtctgcaagatatgtccacaattccccggtcagtatcaatgtattcaatctggctgggtggacttcccttaaatattcccggtgcatccgtccgtactttccgatagggcggtgttcctccggcagtttcaagtccgggatgtaataatctccgacaaggatataatcaattccgttttccgttattcttggtttcaattcgctcatgttccttacctcctgtggaagcaggctcgtctggtactaactcaatcacatcggtaatctcacaattcagcgtttcgcagatacgggctaatgtatccatgctgatgtgctttccctctttgctcatgttggcaatcatatttgttgtcataccagcggcaagccttaaatcctcttttctcatatcacgctctaacagtgtgtgccagagtggcttatagctgatgtgcatattgttttcctgcctttctatctataccaccggggcggctgccccggcaggaacttttctcttattatagcaccaatcttgtgaaatcacaatttattcttgtagcctgccgctgataccgtctggattgtgcttttcctttcgttttttgttccaactaattagccatgaactgcttgatttctggggactggattcttccataccaaccgcttctgctctcagccagcagcgcgcaaagcttaaacctgatgcgctggaagctgtattccggcactttaattccgcttccatggaattgccgcccgcttcctttatggattcgcattaccgtttcctggctgccgatggctctacctgcacttttttcagcactccggctttctcatcaccagactactactgttgaccggcactattgctcttataataacatggcacatgttgtggaacagggacagtatttcctgttccgtaccaaggatatccattccaaaggactggtcggcaattttaattttccagatgcggaatccttcgatattgatgtcagcgtcatactggtccggagccattcgaaaaaagttttggcagacatccacacagaaggttacatacgctttgttgatcaggcagctgctttcgattacattgaatatggaagttatgatacatatgagctgtccttccgtattctacgcttccctatcagcacttctacatacgagtgcatcgtgaccaatctgccacgtgatgaattccctgtggaacgtatcaaaaccttgtacaatgccagatgaaacattgaatcctcattcaggaaactgaaatataccattgggctgagtaatttccatgcgtataaacccgaatacgtgaaacaggaaatatgggcaaggctacttgcatcattataatccgttttgaggcagatttgcaatctgtctttttgtcgtgctttccttcatgagtaaatcgtaaacatatctgtaaaactgttccactaaggcccatctgtaatttgttctgtaagaattcacttcctgattaaacgttaactaaatgacattgtactgtgaacagtaacaaaaagaatgtgcatctccgacacgtagtgccttttgtttcataggaagttcctatgaaataaaaaaggaaaaacagactgcaaataaatcttcacagtctgcccgaaatctctattttttattctttacaattcatcaatctgccagtcgattggctctacaccatgcgcctcaaggaatttatttgtctggctgaacggtttgcttccgaaaaatccacgatacgcagaaagcggactcggatgtggtgcttccaggatcaaatggttcggattggtcagcattctctttttcatctgtgccggtcttccccacagaataaatacaatcggcctgtcctgggtattgagtacacggattgctgcatctgtaaattcttcccagccaattccacgatgtgaattagcctgatgtgctcttaccgtaagaaccgtgttgagaagaagtactccctgctccgcccatttcaccagattgccgtggcttgggatcgtacatcccaaatcatcatgcagttcctgataaatattcaccagtgacggtggaatatcaacccctggtttcacagaaaagcttaaaccctctgcctgtccatctccatgatatggatcctgaccaaggatcacaaccttgacatccttaagcggtgtcagatgaaatgcattaaagatgtcatctgccggaggatatacccggtgtgtccggtattcctgattcactgtttcaaacagtttcttatagtatggcttggaaaattcacctttcagtgcatccagccagtcattgttaattgctgccatattccccaccttttctctacagacgtaccgatacgcctttttctctcaaatattcttttacttctctgatttccagctctttatagtggaacagggatgccgcaagtgccgcgtctgccttcccctcttcaccgagtgcttcgtagaaatgctccagattacctgctcctccagatgcgattactggaattgatacattttccgcgatcgtccttgtcagctccagatcgtatccggccttcgtgccgtcacagtccatactggtcaaaagaatctctcctgcgccaagtgcttctactttcttcgcccactcgactgcatcaatccccatatcaatgcgtccgccatttttatagatattccacccactgccgtcttctcttcttttcgcatcaatcgcgacaaccacacactggcttccaaacttctccgctgcttcccggatcagttccggtcgattgattgcagaagaattgatggaaatcttgtccgcaccttcccgaagcaatgccttaaaatcgtcaacggtccggattccaccacctaccgtaaatggaataaacacacactcagcaactttacgcaccatgtcaaccaccgtgcttctgtcgtccgaagatgccgtgatatccagaaataccagttcatccgcacctgccttatcataagccttcgcaatctcaaccggatctcctgcatctttgagatccacaaaattcacaccttttacaacccgtccgttcttcacatcaagacatgggataattctctttgtaaacactgtctgccctcctacaattctacaaaatttttcagtatctgaagtcctgtatcactgctcttttccggatggaactggcaggcaaatacatttccctgttcaaccgaagcatgaatatgcgtgctgtactcggttgtcgcttttacaatactttcatctgttgctttcaaatagtaggaatgaacaaaatatacatacggctcttcaggtaaatctttaaacaatctgccgtcattctgaagcttcagagagttccatcccatatgcgggatcttaagtcccggacagtccggaattctaaggatctctccttttagaataccaagtccctccacacctggcgtctcgtcacttctttcaaacaaaagctggagcccaagacagattccaagaagcgggatttgtctctctgctacttcacgaagcacttcatccaatccatattttttcagattgtacatggcattgccaaatgcaccgactcccggaaggatcactttatcggcagaaagtatctcttctctgtctcttgtgataaccgcatcctcaccaagatattttaacgctttttctacacttttaatgtttcctgcatcataatcaataatcgctatcatccgcatatcctcacgatttttatattcttgtagttattcaaaagagctttttccgctcatgtcacaatcttcttccctgtgtcaatcagtaataagctcttttataatgtaccacgttacagtgtgaattgcaagatttgcgtttatttcatgtccagttcaaaccagaactcaacaccattggtatgattgatcgcaccgtatccttttccaaaggagtccatgatcgccttcacaatggaaagcccgataccatttccaccgtattctctggtccttgccttatcaaccttatagaatttctcccagatatgtggcagatcttcctccggaatcggcgttccggtattgaatacggtaatttttgccatatcattttcctgggtgatcttgatctcgatcactttctcaccatcgatatggttcagtgcattgttgacatagttccggacaacctgctcaaccttaaactcatctgcccagacataaacagggttcttgtggcggaaaatcacttgtgcttctttctgctcgatcagaatatccagactctgcaggacacccgaaatcaatgaagtaatatcaaaccgttcaaactgtacatcatcctcaccaaattccagctggttcagggcaagtagattcttcaccatccggttcatctttcctgcctcgtccataatgacttcacagtagaactcccggctctccggatcatcattgactccttctttcaggccttctgcatatccctggatcagggcaatcggcgtcttcagttcatgggaaacattccccaggaattcgcttcgcatattttctcgtttttctttctgctcaatgtctttctgcaatttatagttggcttctttcagattggaaatcgtctgctcaagtctttctgacatccggttaaagttctctcccagtacaccgatttcgttgcttccgccgctggtatattttgcatcaaaatccagatcggccatcttctgtgaaagtgttgcgagctccatgatcggctccgtgatcctttttgagaaataccacgcaagcaatacactcacaagaatcacacatccgccgacgactccgataaatctgttaaaaatcatgactgccgaacgaatactctccagcgggcttcgcatgataaagatatcaccattgtcaaagtttccccacatggtcaggtactctgtattattttgcggatcaaccgacttgcagatatcataactgtccgttttttccagaacctcctgatgattcttatcgtacagatatccaaaaagctgtacgaccatcatctgtttttctcttacattagtataaaccacattgtattctgaatcgatgactgcaatggaaatattatttttctctgtaaatcttcccaggtctttttccggtgtctcagaatcgattgtcccgttctccacaccttcctgcaccattgtataggcctttataaattctgatttcttattggaaatataatatttctccagaaaacttccgttgacgatcataaatacaacgatcataaacagaatcagacctacaaaaacagtcatcatctgtctttttattgaatatttcatgactgtacctcgaatttataccccataccccagatagtcttaatataatctcctttatcaccaagtttacttctcagcttctttacatgggtatcaatggttctggcatccccgaaataatcgtaattccatacattgttaagaatcttctctctcgataaagcaatcccctgattctccacaaaataagtcagaagttcaaactctttgtaactgagttcgatcggttttccatcgatcttcaccatatgtgctgctttatcaatctcgatcccgtccgcatgaagcagatcatccgaagcaagcgcattggttctgcgcagaatcgcagtaactcttgcaaccaggatcttcgggctgaacggtttggaaatgtactcatccacaccgagttcaaacccctgaagctcgtccctctcttcacttcttgcggtcagcataatgatcggaacctttgattctttacggatctcacggcaggtctgccagccatccatatgcggcatcatgacatccagaatgatcagtgcaatatctttttcttcataaaaaatgtccattgcttccataccgtctccggcttcgagtacagcatatccttctctttccaggaaatcgcgcaccaatttgcgcatacggctttcatcatctactacaagaattttcagtttatccataactctcacgggctcctttttatcactttatttctaattatacaccagaatagcagataattgtgttctttatgtgaaagaagaacaacaggatcgtagtttcgtatttatttttatcccaaaaagccaagatgctctaacaaaatcttcagaccaagcagaataaggatgatcccaccgacaatttcggctttgttcttatagcgggctccaaagacgttaccaatctttactccggcaaaggaaatgatgaaggtcacgattccgataaaacagaccgccggaataatatttaccttaagaaatgcaaaggtaattcctatagcgagtgcatcaatgctggttgctactgcgagaaggaacatggtcttcacatccaggcttgcatcggcttcctcttcgtcattgtccaatgcttcgtgaatcatatttccaccaatcagcgcaagtaatacaaatgcgatccagtgatctatagaagcaatggcttcctggaactgcgctcctaaaatataaccaattgccggcatcaatgcctgaaatccgccaaaccataagccaacaatagccgcctttttgaaagtgcacttcggcatagcaagtcctttacagacagaaactgcaaatgcatccatggacagccctactgcaatcaaaaacaattcaattaaacccataatttttctcctttttaaagctaatcatcttatccaatgtgaaaataattgtctgcggcaatgctttgcctgcacttggctcatcgtatataatcgagcaggctgactcctactcgatttgtatactttgtacaccatctcgcttaacagctcgatgatgtacattcgccaaatgcagatacttgtgcaagcacaaatctgcacttggctcatcgtatacacaaaaaaagacttattcgtagcgtaaaatactacgaataagtctcattatttaaagctatgccagacagccattgctgtcagtatgttgacaaagctacgtcatcgcgccaactactcccttatcgataaaaattattatatcgggcaggttcttttctgtcaagcctgattctctgtgaattcagattagactcattctcaaaaatcagcttttgactgctacgccatgatcggctttaatgcttctgcgaatttgtctttctttgcctgtgcttcttccagatcttttccaagtgttgtgtaatagatcttaatcttcggctctgttcctgaaggacgaacaataacagtctcgccatcttccagtttgtagatcagtacattcgcagaaggaagtccggtttcttccggtttggtgtaatctgtaacagatgcaaccttgattccggctacttctgtgagcggattcttacgaaggccttccataatacctgccatcttgtccattccgctaagtcccgggaattcaaagctgtctactttgttcagataacgtccgtactgcgcgtagatttcttccagtctctgcttcagtgagcttccgatgcttctgtagtaagctgccatttcgcagatcagcatagatccgataacagcatctttatcacgtacatacggtcctgcaaggtatccgtagctctcttcaaatccaaagatgaaacgatctacttctccggcttcttcaagctgtgcgatctggtcaccgatccacttgaatccggtaagtacacttctgagttctacaccgtaatgctctgcaactgcatctgcaagcggagtagatacgattgattttacagcaactgctttctcaggcatggttcctttttcaatacgtcctgcgcagatgtaatcgagaagcagaacaccgacttcgttaccacttaccagttcgtaagaaccatccgggcacttcattgcaatacctacacggtctgcatccgggtctgttgcaagcatcagatctgcatctgtctcttttgcaaggttaagtccaagctccagagctgcaaaaatttccgggttcggataactgcaggtcgtgaagtatccgtttggatattcctgttccggaacgattgtgatatctgtgattccgatgtcttttaatacctgtgttaccggaacaagtcctgaaccattgagcgggctgtataccagcttcagtcctgctgtcttgcaaagccccggtcttacctgacgtgattcgatcgcttcataaagcgccttcttgcagtcatctcctacaaaacgaatcagccctttttctacaccttctgcgaaggatatgtattttgcacctgtgaggacatctgtcttctggatctcagcatatacgattgctgctgcatcatctgtcatctggcatccgtccggtccatatgctttataaccattgtattttgccgggttgtgggatgcagttaccataacacctgcattgcagttataataacgtgtcgcaaatgaaagtgccggcaccggcatcagcgcgtcatagattctgacattgattccgtttgctgccagaacacctgctgctgtctttgcaaatacatcactcttcagacggctgtcgtagctgattgccacagtctgtgtgccaccctgtgtcttaacccagttcgccagtccctgtgttgcctgacgtactacataaatattcatacgattcgttcctgctccgagaactccacgaagtcctgctgttccaaacttcagagctacagcgaaacgatcttttatctcttcgtcatttccttcaattctcgctaattccggactcagatcggcatcttccagatctgcttccagccaacgtttgtactcttcctgatacatcttgaccactccctactataatttgttcttatttttgtacattttgacaaaaatatactttaaatataccatatctttgactaacccgcaatgatttgggtgagaaaagtccgttaaaacattcttcgttttcatcttcctccataactaaattgttctctcaccatcatcaaagcatatccaagtaagttctgacctttccacttatccagatcaaatctgttctcatctttcatggataacccgattccccatatctgatcttttaccgcacattctgataaataccaattcctaaatatccattttcttcatctggattatgaaaacaaataatctccatcaatcttcacccaacctttcactacaatcataccagatttatatctttcctgccatcgcaacaagcactttcatcaccccggcaagcaccatcacccagattggattcatcttcaccttcctgagcaagatcacacataccacaaatattccaaccatcagccaactggtatcagatatcaccattttcccggaagcttcccagaatgctgtctgcaaaatggaaattcccgccgatccgatcagtgcgaccaccgccggtctgatccctccaagtattccctgcagcatgtccatttcccggtattttaagtacaattttgcaatgatcgtcacgataatgcaagatggtgtgatatatccaagtgtagccacaaccgctcccggcattccggtcagtttcatcccaacaaaggttgctgcattgatcgcaatcggtcccggagtcatctgggaaatggtgatcagatccgtaaattccgtcatgctgagccagtgatgcacatttacgacctgcccctggatcagtggaagtgccgcatatccacctccaaagctgaacaagctgatctgaaaaaaacttaaaaataattgtatatacatcatactcttttcctccgtctgttccagattgtccggattacaccaaaaactccacttgcaatcacaatataaatcacattgattcccaatacacaggctgctataaaggctacaatcataacaatcgttgccacattatctttcttttttataattccacatcccatttcataagtgaccgaggcaatcacagctccgacacctgcctgcatcccttccagcatctgactcaccagataattatcccgaaatgcatgataaaaagcagagatcaaagaaatgatcacaaacggtggaataatcgttccaataattgcaaccagtgttcctgcaaggccggcaagcttatacccaaccacgattgccccatttaccgcaatcggtcccggtgctgactgcgcgattgccaccaaatccagcatttcattttcttcaatccaatgataatcatccacaaactttttcttcatcagcgtgacgatcacataaccgccgccaaatgtaaatgcactcagatataatgtagatagaaaaagtttaaccaacacttctcttttattcttcataatttttatcctccacccattagtatatctttgctttatacagatgtaaattaaaatccaggtaaatttcaaaacctttccgaaacctatccaatacaattttatctcttgacttttccaacaatctcatttatcatatataacatatcaatttagtaggtttataaaggagtgacacagaatgaacatcttatgctttggcgactcaaacacatatggctacaaaccggacggaaccggcagatttgacaccgacacccgatggaccagtctgcttcagaagaagctgggtgctgaccaccgtgtgatcgaagaaggtctttgtggaagaaccactgtatttcaggatgatcttcgtgagggacgccgtggacttgatctgatcggtgtcacgatggaaatgcatacccctatcgatctccttatcgttatgctcggaaccaacgactgcaaaacgagatacaatgcgtccgcaggaaccattgccaaaggattggctcaagtcatccaaaatgcccgaaaaaacgcttcccagccttttgatctcctcgtcatttcaccgatccatttgggtgaaggtgttggcgatcctggctttgatccggaatttaatgaaaaatccgtagaagtttcaaaaaagcttgctgaagaatatcacaaagtggcacttctgcatcatgcagcatttctggatgcctccgcatttgcatctccaagcaccacagatcgcgagcatctgaatgcagccggtcacgctgcacttgctaatgcaatctatgaaaaagttatcgatatgcaaaaaaaactggaaagagcggtatagatttttaacgtctataccgctcttcgtattcttcattaaatataaatccgcatgatattgatcacaaatccaatcgccccaagtgtcataaacacaagcgcagctcctgctgccttttttcttgtttcaatcttttcctgatcttcgatgctcatattctggaccggatattttcttctaccgatcagataaagaatcagtccacttgaattatttccattcatcgcccaaaatccccagaatttcgggtgctttaagcctcttgcttttgcatctgataccgtcatctgataaatctgccatgcggtgcagattgctcctaccaacgcaattgctccgcttgctactgctgctatttgattccatcccataataatctgcctcctaaatccgtttgataatctgataaagcaataccgatgaactcatgattaccacacaaaatacaattaccagataataggttccttccggcaacagcatgttcagcgcaatcaacagtatcatcagtataatatttaaaagaattgctccagtcagttttttgttgctttttacaacatttgtactctcttccagatgttctgccatcttctgatctcctttcaacagttcatcaagacttacggaatatagatcactaagtgcaatgacactgataatatctggatacgatttttcattttcccaattggaaatagtctggcgggaaacatcgattttctctgcagccttctcctgggtaagcccggcttctatccgtgcattttttagtttcttccctattttcataattcctgtttcttcctttcacggacatcattccatatagaacaccaaaagtctatcaaacctcttttacaaatggcatttttgcctgtcaaaattcttttacaccggcaaatatacctgtatcttaccatccggagagatttgtatcaagaaaactatggcactttctcctcgcatctgttaaaataggatttcagaaacggaggttttgaaatgctaaaatcctatgtctgttttgacctggaaacaaccgggcttgacccactatataatgaaattattgaaatcggagcattgaaagtccgtgacggaaaggttgccgaacgttttatggaattcattcatccacaggaagagatttccccgatgatcacgaatctcaccggcattacgaatgaaatggttgcaaatgccagacctgccgatgctgtgatcagtgattttcttgaattctgtgaagatgatgtcctgatcggccacaatgtaggctttgattacagcttcatgaaatcaggtgcttccaatttaggacttacttttgaaaaatttggaatcgacacatttaagatcgcccagcgcaccttaaaatcacttccctccaaaagtctctccagtctgtgtgaatactaccagattgaaaataaagctgcgcaccgcgcctactatgatgcgcttgccacagcaaaactgtatcagacactggcacactatttcgaaaatgaggatccttctcttttcaagccacagcagcttacatacaaaataaaaaaagtgcagcctgccacatcaaaacaggttgcacttttgcagagactgtgcagccagaagaaaaaagtaccggaatggaatccggatacgatcacgcgcagtgaagcatctcgactgattgacactttattaaaggcataagcaaaaagatagaatacgtcttaaagaatcttctttcttataaacgtactctatctttttcttatctcagaaagatctgccccgtcaaatataattccttactgatctttcgcatattgtttcacctgcccgaaaataatctcttccggatcttacttatttactttccagttttccagaagttttaattctattttcgttccggcttttcaccgatttctctccacatatgcatttcaaattattgacgaataaggctgtgacaccagtcttcatgcaactgacgttcaaggttattggttgtgggggcgatgtgtggggatattcgttattgtatatgtagaagctctaagacgttagctaatgtaaaactttctgctatgcaaaaaaagaagccctcacacaaggactccttcgtaagtagcgggaactggatttgaaccagcgacaccgcgggtatgaaccgcgtgctctagccaactgagctatcccgccatatgaaatttacaacttatgttgtaatgggaccaatagggctcgaacctatgaccctctgcttgtaaggcagatgctctcccagctgagctatgatccctcatcacatttatgcgacttgtttagtctactattattttctacaaatgtcaatactttttttagttttttttacagattttctctttttctgtcagcatatctcccccttacttcctgctttccagaccattacctgtagatttcttcccaatgctcttttgtcataacattcgtatgctcgacccgcacctcatgtaaaagcggcacaggaacttcattacaggtatgatgataaacaaatcccagcttttcctgcactctttttgatttcagattgccatcataataagcgcaccagattgttgtcatgccaagatcttcaaatccatgtctcaataactctctggaagcttccggcatatagcctcttccccagaatggctgtccaagccaatatccaagctcacactcatcgtcacgctttgttttattcgtgtatccattcagtttcagttccacagcacctatcgcaatattattttccttttcacagattgcgtagcactctgctccatcaaatacatttttgatgacagctctgctttcctccacactcttatgcggcggccatcctgcagcaggtccgatctccggatcttttgcatattcaaacagactttccgcatcttcctctgtccattttctcagtattaatctttcggtctccagcatactcttccacctcagtctttatatttaaatttttaataaatttgttttcttcaatttctattctatacgttaatctgttgtctcagtatatcataaggattttatagtttcaacattccacatttgcatggttatacgtaaaacgtatttcaataattcattttttctatatatcgtcctatttatagttattttacacatttcaccatatgcattgactaactcattcgtcattttgtacaatatttcatatggatagcgacaaaatatatggatactaacaaatcgtcattgtataaaaggaggaaatgaaatggctgattatgaaaaaatgtgggaagaccttgggatggatgtcaaaaatcatgacaatctctgtcaggttcttccgacagcagttggggatgtatttatgacacaggaaaaccgtccgaaagcaatggatttctgggatatggtcattgctgaggttcacggtatccgcccggctgaattaattgaagagcagaaaaaaggacgtaaagtattcggaacattctgcgtttatgtaccggatgaagtaattatcgctgcaaatggtatcgtaaccggactttgcggcggttcccagttctgggttccggacggcgaaaaagtccttccgaaaaatgtctgtccgcttgtaaaagcttctgtaggagcaagacttggacgcacctgcccattcttccgtatcgcagatatgtatatcggggaaactacctgcgacggcaagaagaaagcttacgaaatccttggaaaagacgttccaatgcatattatggatgttccacagatgaagcgtgaaaaagatattatcaaatggaaagaagaaattacagattttgcaaagattgtagaagaatttaccggaaacaaaatcacaccggaaaaccttgcggaagcgatcaatatctgcaataagaaacgtaaagctcttcagagagtttatgactgcagaaaatcaaaatgtctgccgatttccggacgagatgctctgctcatgacccagatttccttcttcgatgatccggtacgctgcgcccagatgtgtaaccgtctggctgacgaactggaacaacgaatcaaggatggtgtatctgttgtaccagaaggcacaaaacgtatcctgatcacaggaacgcctcttgcagttccgaactggaaattacataacatcatcgagacaagcggcgctgctgttgtctgtgaagagatgtgtacaggaacaagatattttgaaaatcttgtagacgaatccggtgaaacactggatgaacagttcatgaatctgtccaaacgttacatgaagacaaactgtgcatgcttcacaccaaatacgggacgtatcgacgatattctccgtatggtcgacgaatatcaggtggacggcgtcatcgactgcagtctgatgttctgctgcctgtacgacacagaaaaacttgcagtttctgaagcattgaaggcgaaaaatattccggtactctctctggaaacagattacaccgataaagatgctgaacagcttcgtacaagaatcggagcatttgtggagatgctgaatcagtaaaatggaagaaaaaaataaacatatccgctattatattctctttgacaatcacacacagggcatgatgctccatgagcttctggataagcaaggtcttcctaaccgtattgcacctgccccgcgtgacactgatggcaaagctgcctgcggaatggcgcttctgatccatccggatgacattaatgccgtcaggacatgcatcgaagagaatcatgccgaatatgtaaacatcgttccattggaaaatcagttgcagaaaaagagagaccgatattgttaaatgcagagtatatgataaatgaggagagagcaaaaagctctctcctcattttgactcatcatattcaaaaaccgctgaatcatctcattttcagcggttttacaggtatggacctgaggggaatcgaacccctgtccgaaagctcttccataaaggcatctcccatcacagtcattcttttgacattccctccataagccgccgaacaacaggctgcttactttagtagcttcataaattcttccattccctcaaagctttggaaacgaagtgcctcatctggtcgaagccggttacttaagcgatgagagactcaaggccgactgctgcaactaggcagcgtacgctaaattttcgtctgcgtttatatttagttggaacttttaacgtagtgtcccgctacggatggcttccttgacttccgtgcccccgtcgaaaccagtacaagccctggttcttggaagccgtatcatcaaaaatacgcttctgcaaacaagatccgttcagaagtcaaccttctgccctcccatttgctctatatattatatgcggacatccaggctcatgtcaaggcatctccgcatataatttactcaatctgtcattttacgcttcttttgtcttccccacttccagcattccgctctttgcaagtgccggtcgcagtgcattgtagatgatcactacaacgattgtagaaaggactgcatttacaaaggtagcagctgcgctccattttgcaagaacctctgccatctgctgcggctgtcccagaatgtactgtttgtaaaagtatccgacgatcggatctgcaatgacattaaatgcaagtccggctacagatgccagcaggctccatttgaaaatgtatttcttatcggtactttcattgatctttgcgatcttatgcgctacaagtcctgtgatcagtccgatgcagagcttcaggataaatgtcttcggtgctccggtaatatagatcggatccatcacatccgcgattcccattccgatcgctcctgcaagtccgccgtaccagccgcccaaaagaagtgcggcaagcacacaaaacgcatttccaaggtggattgatgttgcatctcctcccggcatcggtattttaatctgcagatacgtaaagattacgtagcaaagtgcagcaaacagcgctgtctgtgcaattttcataacggttgaatttgttttcatagtctgtcccatcctttcttattccttgtgaaacactatagtacattgattcatcaggttattgaacattgtaccgcgtcactgtctctgtaaaaatatacaattttcacttttttcaaggggacagttttgttttatccgaaattgcggatcttgaattctctttctgcctcacgcttctggtcttttttcgcgatatcatcacgcttatcgtatagttttttaccttttgccagtccgatctctactttgacaagactcttgctgaaatacaccttcagtggcacgatcgccattcctttttccttggtcttaccgatcagtttgttgatctccgatttgtgaagaaggagctttctcacacgcagaggatctttattgaaaatatttcccttttcgtatggactgatatgcattccatagatgaacacttccccatcctcaatacggataaaggattctttgatgctgcattttcccatgcggagggattttacttccgtacctgcaagtgcaattcccgcctcataagtatccaggataaaatagtcatgatacgcctttttattgttcgcaatcatcttgccctgcgcttttgccttagccatcttctctctcctcttttctttcctttacaagtctaaaatcaatggttcttgatatctcatcacaatcgatcatcttcacacgcaccttctgccccagcttgtaggtctttctgtgatgggaaccaatcatctgataatgttcttcatcgtaatcataatgatcgtctgtcatattggtaacatgcaccagaccttctacggtattcggaagctctacatagattccccacttcgtgatacccgaaataactccttcaaattcctgtccgaagaaattccgcatatactgtaccttcttcagcttcagcgtctctctctctgcctcatccgcacggcgctctaaggagcttgtctccatcgccacctccggcaggattttttcataatgatgcctctttgcatcgttcatcctgcctcgaagattatctttgatgatccggtggatctgcagatccggatagcgccggatcggtgaagtaaaatgcgtataatactgggtcgcaagtccgaaatgtccgtcattatccggcgaatatctcgcctgcttcatcgaacggagtgcaagccttgagatcatggcttcttccggagtcccctcgatcttatccagaagcttctggacttcctttggacggatctcctgtcctccctgcatatgcatggtatatccgaaattctgcaaaaatgtcacaagtttcttcatcttatcatcatccggtgtttcatgcacacggtataagaatggaatctcctgccagaaataatcctctgcaaccgtctcatttgcaacaagcataaaatcctcgatgatcttcgttgccacgttgcggtcgtaagccttaatatccaccggctcaccgctttcatttaaaataatctttgcctccggaaaatcaaagtcgattgcccctcttctgtggcgtctttctctcaaaatgtgtgacagttctttcatcagttcaaacatcgggatcagatcatgatatcgttcgcattctgcctcatcccgatcctcaagaatctttttcacactggtatagctcatgcgttcatccacatttaccacagtttctgcaatctggtgatcgactacatttcccttcacatcaatggtcatgatacagctcagtgccagccgatcctcgcctgcgtttaatgaacacattccattagacaaaactcttggcagcatcgggatcacacggtctgccagatagacactggtacctcttttcagtgcttcccggtcaagagcgctgttctcctgcacataattggtcacatcagcgatatgcacgcccagaatataacagtctccctcttttgtcagagtgatcgcatcatccagatccttcgcatcctcgccgtcgatcgtcacggtctgccagctccgcacgtccttacgtcctgccatatcagcggtcgtcactgcctttgccacacgctctgcctgattcagtaccttctccggaaattcggttggcagatcatatcctttgacaatcgacaaaatatcaactcccggatcggtcacatgccccaggatctctacgatctttccttccggcttctttccattctccccataagaggtcagctctaccacaaccttatgcccggtcacagctcctttagagcgctctgccggtacgaagatatcctgcaggaaacgctcattatccggcacaacgaatccgaaattcttccggctctgataatagccgacgatccgctgggttcccctctgtacgattttcgtgatctttccttctcttcgcattccttccggtgctttggtgatgacaacctctacctcatctccctgcatggcaccgttcatatcattttctgagataaagatatcttcgctctcaccttccacagtgacaaagccgaagcctctcgcgtttgcctggaacattccacgcagctgctttgcctcacctttgatgtattttcctttctgtgtgacatgtaccctgccttctttttccaggctgtccatgacagctttgagttcccctttctgatctttcgggacctgaagcagcatcgacaactctttcagcttcatcggcacataaaattcgtcacagataaattcataaataattttctttcttttttcaaataattcgtccatctcttctcctgtcaaaaaaggaacaccctatagatactatagagtgttcctcatcttctttcaatcattcgttatgcaaaaactttcaagttcaggactgctgcaagtacaataaacagaattgctaaaaacttggtagacttaacaagtgcgccttccatagaacgtcctttgttctgtccccaataagaatctgccatacctgcgattgttccaagacctgctgacttaccttcctgcatcaatacgattactgtcaatgcgatacaatctattgcaaataaaattaaaagtactgtttttaaaatttccattactaatcacacctcctgatggctaaaccactcatgtattttaccataaatctacttccgattcaagcagatttcatggatttcagtctttattttaccagtttgcttcctttcagcttcacaacacggtcaattcggttaatggatgacatccggtaggcataagcccccgactcgaaaagtgcataaatgctgccaccgtcctgatagatctgttccagcctctccggaaacttgatcgtcttataagcttcggaggttgacaagattccatatctggaatagttgaagatctgtacctccgatggcaggatcccccaggatctggtaagcaggatcttattgttgtaaaatgccattccctgcaccttaccggaaattacctgcatactgaccgcataggcaaccggctccgtcacgccgaccgtccgtttcaggttcatgtcttctttttcatacaaggtgccgtctgcattgatcagatatttttcaatgacactggcattatcctgtgtaaagaatccgacaaacaatgcgccatcatgatacgtcataaatgacgcccgcttgatcttataaaggttgtaagacatatcgaattcaatcggatgatatccgtcatcaaaggaataattttccagatgagacagtgtgatcgcatttgcctgcgcccaggtggaaccctgtcctgtcacccacaggatctggttcatcgtatcgtatgccattccgcccacatgggctttggtgttcagcacaatctctttcacaaaccgtctgctttctttgtcgatcacatagatcaccgaatcatgtgcctttgtcttacaataagcactgaccagaatataatcctctgtaaatgcaagtccctgtggtgtcatggatgtgcagacttctgcttctccgtccccttttactttcagcgtccttgttgacttcagtccaggcacaacataagtcccgtagtcattgtccacttcggcttcatcgcacgcgtacttataaacagtctggttgcgcttcagcgttttcagatactgctccatcgtgtaaacggaatccgtattcgtcaccttccggtttgtctccggctccacctcggctctgtactggaatgcgtaataccagtagcttcctccgatgattcccacaaccagaagaatactgatgatactgcggatatgtccaaacatggtcttctttttccggacctttttcttctttgtttttttctcttcctgtcttacttcctcattctcaagctcttgtttattcattcatgcccacttcgtttttatatactttctgtgttgaaaatccccgtcctctgacctcatttacattgccaatgatcataaatgcctgcggatctgtctcctgcacgatctggttcaaccgcatcagttcacggttagacacaacggtaaggatcatcggctgatcctttctcaaataaccggtctgcgtgtagaccagtgtagttcctcggtcaagcttctcctggatcagatggttcagcttctcatactctccggaaatgatcttgacctgtgttctggtcgatcccatcagaagcactttatccagcatcaccgtgtaaatcaatactagaagaataccatagatgatctcttctttattggtaaataccatctggaagatcagaatcgcaaaatcaaatacatagagcataacagataccggaagtccgaatttcttattcagtaccagcggcgggatatccatacctcctgttgatgctccgcatcttataacaactccgattccaagtccgatcatcagacctccacagatcgttgaaagcatcttatcgtctgtgacgttctgtaataccggaacattctccagtattcccagaatgatcggataataaaacgtactgaccagtgtagtaagtgcaaatttcataccaagcactgcagcccccagaagaaacatcagtgtgttgaagatcagtacaaatgtatggatctggaatccaaaataatgattcacggcaattccaagccccgtggtccctccggtaatgatatcattcggcaggataaacattacaattgcaagtgcatatactgtattccccaataaaatcagacacagattcctcatatttgacattttcatattacgctctccttgacatatgtattttgtctgcagatttccccaattttccacaatccaatactttatagtatactcggtgcatgtttttgggacaaggaatttttttattttattctcttttttcgtttcatttggtatactgtgattaaaaagacaggttttgattttccaagaaaagaggttatcaaattatggacaagatcagacagttacaggacatgattaacgagagcaaccgaatcgtctttttcggcggtgccggcgtctctaccgagagtaatattccggacttcaggagtgcagacggactctacaaacaaaagtaccgctactcaccggagcagattgtaagccacagctttttcatgcagcatacggaagaattttatgatttttataaagagaaaatgatgttccttgatgcgaagccaaataaagcacatctgaagcttgccgaactggaagccgccggaaagctgaccgccgttatcacacagaatatcgacggactccaccaggctgccggaagcaaaaatgtactggagcttcatggaagtatccaccgcaattactgcatgcgttgcaaaaagcagtacagtgcacgttttgtaaaagaatcgaaaggaatcccaacctgcaactgcggcggaactatccgcccggatgtagttctctacgaagaaggactggataatcagattatccagaaaagtatccgcgccatctcagaagcagatatgctgatcatcggcggtacttctcttgtggtctaccctgctgccggatttatcgattatttccacggcaaatatctggtactcatcaacaaagatgcaactgcccgtgatgtaggcgcaactctgacgatccatgagccgatcggagaagtattagaccggatccatgtatagccggagaatccaaaaatcctctgcctgccctttctaatgaaagagtgacagaggatttttcattttaaccgttatacgtcttaaaaaactgatacaggttgtccagtgcctttgtcagaaccgggatctcttcttcatccagcgtctcaacaacagcttctaccatcttcttatgaaaattcgcatgatgatgatatgccttctcccctttttccgtcagctggatattgacgatcctccggtcttcttcgctccggtggcggactgcatactttttattgaccagactgttcatcgaagttgtcagtgatccgaccgtgattccgagcttcttcgcgatcgtggacatattattcccggtcccaagtccgattgcttcaataatatgcatatcgttattcgtcagatccttgaattcttctgtgatcactgccttttcttctaattcccatatatcattaaaaagatgtaccaatatcttattgatgctttcgtatgcgtccaattccccttcttctccttgctgtgtctttttctagttcaattatacacagtcacctaacaaagaatcaatcacttctttcacagtttctattttttctgctttccacacatccgctccgcagaacagaagtgcctctccaatctcaccttttgccgctttgatcagcgcttccgtgatacagtatggcacttccgccgggttacagtttttcagacacccaagacatctcttaggcttcaccctctctcctgccattacatgactgataaatggattcttaattgcccttcccggcattccaaccggacttttcaccagaatgacatcctctttcttcgcattcagataactctgtttgtaactaagatccgcatcgcactcccatgtcgtgacaaatcttgttgccacctggactgcatctgctcctaatgaaaaggcatgctctgccgcatctttatccgaaattcctccggctactgccaccgggatatgcacctgatattttttggcgtactttctgaccactgccatgatcctctcgatttcattatcatagctttcctgtgtgtaagtttccagctgctcccggtcaaatcccagatgtcctccggctttggggccctcgatcacaaccaggtctgcggttctggaaaattttttatcccagtattttaagataactttcgccgatttttcagtcgatacgatcggagcaatcttggtactgctgccctccacaagtcccggcagctcgattggaagccctgccccggatacgatcagatctgctccggcgtccactgctgctttcacatgctcgtcataatctttcagtgcaaccatgatattaaatccgatcacgccatccggagccgtctctcttgctctttgaaattcagatccaattgcacggatatttgccgcccttgtattcgtttcaaaatccggttcacggaatccgatctgtgcggttgagatgatcccgactccaccttcttttgcaaccgctccggcaagctgcccaaggctcacaccgactcccattcccccttgaatgaccggtctttttactttcaaatcaccaatcacaagttccggtaatcctttcatttttcttctcctctttctactacatcctgcggaatctgtcataccgcttttcggtaagttcttcctttgtcattgcaccatattttttcaaaaaaatactgatataatcatccatcggatctgtcacttctgtaaatgtttccagattgaagttttccggctccggaatcacccgttctacgataccggctttcaggagacgatctgctgtcagcttcatcacacctgccgcctcttttgcgcggctgctgtccttccacaggatacttgcaaatccttccggcgaaagaatggagtaaatcgaattttcaagaagccacacttcatctgaagttgccatcgcaagagctcccccgcttccaccttctccgatcacaactgacaggatcggaacctgaagatttgacatctcaaataaatttcttgcgattgcctcaccctgtcctctctcttctgcttccagcccacagaacgctcccggcgtatctacaaaacagatgaccggacggttaaatttctctgcctgtttcatcagacgaagggctttgcggtatccgtccggtgacggcattccaaagttacgctcgatattttcttttgtcgtgcgaccctttgcctgcgcgatcaccgtcaccggcattccgtgaaatcttgcaatcccgccaatgatcgccttatcatcctggtaataacggtctccatgaaattccataaaatctgtaaataattcttcaatatactccgcaccgaccggacgagccttgtctctggataactgcacccgttcccatggtgtcagattcctctgtaccgcctgtgtttccttttcttctacttctggcaaatcgtatgtaccctgcttatgcattgctacaatttccgccagtgtctccctaagacgcggacgctccacaatctgatccacaaatccgtgctcctgaagaaattctgccctctggaatcctttcggaagcttctgccctatggtctgttcaatcacacgcggacccgcaaaaccgatcagcgcccccggctcggcaagaatgatatctccaagcatggcaaaacttgccgttaccccgccggttgtcggatcggtcagcacacttacatataaacagcctgcatcatggtgtcttttcagtgccgctgaagtctttgccatctgcatcagagagtggatcccctcctgcattctggcgcctcctgaacaggcaaatataataatcggaatcctctcactggttgccttttctactgcacgggtaatcttttcgccgaccacctttcccatgctcgccatcataaaccgcccgtcacagactgcaagaactacttcatttcccgcgatccttgcttttccggttacaaccgcctcatcaagcccggtcttttcctgcagtgcttctaccttttcttcatagcctttataatgcagcggatttcctgaagtcagtcccttgtcccactcttcaaaggtgcccgcatctgctaccatttcaatccggtgcatcgcatgcacacggaaataattctgacattttggacaaatataatatccattcttcacatcttctgtcagaatggcagatttgcaaacgttacattttttcagaagtccctccggaacttccggtgccatatgggcaggctttccttcgccaagagatatataccctcttctgcttgtttttttaaacatatttgacagtttcaaattgctttacctccgcttttgtagagctaaccttgccgattctttgcttctttttcggcaataaattcaatatcaaaatctcctgcctgatactttggatcatgcaaaatatcatattgataatccacattggtatcaatgccttctataattacttcaccaagtgcactctgcatcttccggatcgcttcagtacggttctttgcaaatacgatcagctttgccagcatattatcataatatggcggtacagtgtatccactgtaaattgctgaatcaatccgcacacccttgcctcccggaaggtacatatcggtgatcgttcccggacacggacggaaattcttttccggattttccgcattgatcctgcactcaatggcatgaccggtcagttttacatcttcctgcgtaaaggaaagccgctgaccgtctgcgatccggatctgttccttgatcagatcgatccccgtcacccattctgtgaccggatgctccacctggattctggtattcatttccataaaataaaattttccactcttttccagcagaaattcaatggttcctgcattttcgtaatgcgctgcctttgccgcttttaccgctgcttcgcccattctccggcgaagctcatccgaaatcacggcacatggggattcttcgatcatcttctgatgatttctctgcaccgaacagtcccgttctcctaaatgcaccacatttccatacttatccgccatgatctgaaattcaatgtgcttcggatgctgcacaaaatgctcgatgtacatagtgtcatctccaaaagctgccttggtctctttctgtgcagtacggaatgccatgtcaaatccggcttcattttccgccacacgcattccttttccgcctccgccgagagccgcctttacgatcaccggatagccgatctctcttgcaacttcttttccttttgctgcatcataaatcgcttcccggcttcccggaatgatcggaaccccggcatttgccatggtatttctcgcctcggatttatttccaagcctgctgatcactttcgaatccggtccaataaaaatgatgttgcacttctcacaaagctctgcaaatttcgtattttcagaaaggaaaccaaatcccggatggatcgcatctgctcccgacacgatggtcgcgctgatgatctgctccatattcagatagctttccgaagatggtgcaggtccgatacagattgcttcatctgcaagctgtgtatgcaatgcttctttatctgcttctgaataaactgcaaccgtctcgatccccatttcccggcaggcacggatgatccgaactgcgatctctccacggtttgcgatcaatactttcttaatcatctgtttccgccttcccgatcatcagagacaactctgcctttactgcaacttctccatccactgatgcaacagcttctccgattaccagtggtcccttctgacgaataattcttgcttccagttttaacttgtcacccggaacaacttttctgcggaacttgcagttcttaatcccaccaaaataaccgagctttcctttattttcttcctgcatcagaaccgctactgcaccgacctgcgccagtgcttctacgatcagcactcccggcatcaccggctcctgtggaaaatgtccggcaaaaaagtcctctctgtaagtcacacatttatagccaactgcatattcccccggctcgtaatcttcgatataatctaccagcaaaaacggatgtctgtgcggaatgattttctgaatttccttgattcccaaatgtttcatgcttttcgccctccatccagctatgcgattcggaataatggctgtccgtattccacagtttctccatttttcacgagtacttccgataccacaccgtcaaaatcacactcaatatcattcatcagcttcatcgcctctacgatggcaaccgtctgtccttttgacacatgatcgccaactgccacaaatggtgctgcctcttccgacggtgctgcataaaaggttccaaccagaggggatttgatcagctgcccttctgcttcttttcctttttccggtccatcctccgacttcagtgccgataccgcattactctgcgctcctggcacgttttgtactgtcgtcagctgtgctgcccctgtactgacaaccatctgttctttttctttctgtattttcaatttcacaccgttttcttcatactgaaatcctgtcaggtccgaatctgaaacggtctgaatcagttttaccagattttctaattccatccttctacctctatccttcatacttcttcaaaagaagggttgcattgtgcccgccaaatccaagggaattggtgagcgcacatttgatctctttttcgaccggtgcgccaactgcatagttcagatcacattcttcatcacattccctggttccaacggtctgatggataaatccatcctgaatagattttacagtaacgatacactctaccgcacctgccgcaccaagaagatgaccgatcatggatttcgttgaattcacaaccacatcctttgccgcatcgccgaatgctttcttgattgcataggtttcaaacagatcattgtggtgcgtgctggttccgtgtgcattaatgtactgtacttcttccggtgtcacgctgccctcttccatcgcaagctccatcgcctttgccgcaccgcttccgtcttctgccggggaagtgatatggtaagcatctccggttgccccgtaacctgcaagctctgcgtaaatctttgcgcctcttgctctcgcatgctccagctcttccagaaccaccacaccggctccttctccaagaacaaacccacttctgtctttatcaaatggaattgatgcacgcagtggatcttctctggtagtaagtgcggtaagtgcggtaaatccggcaatccctgtcggacagatacagctttccgtaccacctgcaaacattacgtccgcatctccgtactgaatggcacgaagcgcatccccgatacaattggttcccgttgcacatgctgtaacgacatttgtgcactttcctttaagcccaagctggatcgatacatttccggctgccatattggaaatcatcatcggaaccatcagtggtgctacccttcccggtcccttttccaggattgtcgtgtactgcttctcgatctgctgcagacttccaattcctgaaccgatgatcacgccacaacggtacggatcctctttttcaatttcaaatcccgcatccgcacacgcttccttcgccgctgcaaccgcatactgggaaaatgtttccattctcttcgatgccttgaaatccatccgttcctttgcaacaaagttcttgacttccgctgcgatcttcactttatattcggttgtatcaaattttgtgatcggaccgattcctacggttccatttttgataccgttccagaattcttctactgtattaccaatcggggtaatcgctccaagccccgtaataacaactctgcgcttcatattgcctcctttggtgtgttgttgactgtttcactttttgataaaatttatcatcttataagtatttttaggttaagttgaatgacaaactgtacaaaagatgtcattcaaattcatttttcgagcaatggagatgagactcaaaggattgtggaagcctttgctgacacaatccttggtttcagaggctcatcggaatggtttgcgagtctgaatttgaaggacatcttttgtacaatttgtccctcaaccttctctgcaaccatttttacatcaccatccccccatcgacctgcagaacctgccccgtaatgtaactcgcatgctcagacgccagaaacgccactgccttcgcgacatcttctggctgtcccattctggcaagagggatctgacctctcatttcttctttgagcttatcggaaagaacttctgtcatctccgtttcaatgaagcccggtgcaaccgcattaaccgtgattccgcgggatgccagttcttttgccgcagatttggtcattccaataattcctgctttagatgcagcatagtttacctgaccggcatttccgctgattccaactacagatgcaagattgatgatctttccgcttctctgcttcatcatctgtctggatgcaaaacggatgcaatggaaagttcctttcagattgacatcaatgacatcggagaaatcttcttcactcatacgcatcagcagaccatcctttgtgatccctgcattatttaccagaatatcgattcttccaaactgctcgatcactgcttttataaatgcttcacatccctcgtaatctgccacattgcactgcatacactgggcacatccacccttttctacaatttcatgttttacttcatctgcttttgcttcagaaccattgtaattgatcacaactgttgctccctgtgcagccagctccttcgcaattgcctttccaattccacgggacgcgccggtaaccaccgcgatctgtccttccaaatttgctctgtctgtcatatgcttttcctttccattgcctgttttttacaccagttcagcaattactttttccatatcttcccaggtttcgatattatatactttgacacctttgtcgatacgccgcataaatccggcgagtgtttttcccggtccgatttccacaaaagtgtctacaccatcttcaatcatagttctcacactttcttcccatcgtaccggtgaagaaatctgttttgcaagaagtgcctttgtctctttgatatccgtcacatattttgccgtaacattcgtcacataaggaatggcaagtggttcaaaatttctcttctccatttccttcgcaagctcttcgcctgcactttccagcatctttgagtggaacggaccacttacatttaacagaaccgccctttttgctccggctgcttttaaagactctgctgccttttctaccgctgcggtctttcctgtaattacaatctgtcccggacagttataatttgccacagacgcacccggaatttcttccgtcactttttcaaccgtttctccatccagtcccaggattgccgccatggctccttcacctgccggaacggtattctgcatcagaatccctctttttctcacaagagaaatggcgtctttcggctgcatgcctcccgctgcgctgatcgcacagtactctccaaggctgagcccggctgtcacatccggtgtaagacctctcttttcaatctcggctgtcattgcaagacaggctgttaccatggctgcctgagtgtattctgtctgatccagctgctcattttcttcaaagcaaagctttgtcatatcaagtcccagctctgctgttgctgtatcaaaaatctcttttgcaagttcactgttttcataaaaatcttttcccataccgcacttctgcgcgccctgtcccgggaaaatgaatgctgttttattcataaaatcctttgcctccgatcagtgcatccgtctcacttaccagcttttggatcaggtctttacaactcatgatctcttttaccatggctgcactctgtcccgccattacgcttccgtttgtcacatctccgtctacaacggcctttcttaagcctccaagtgtaaggtgctcaagttcttcaaaggatgcaccgtttttctcaaggtccagatattttttcgtcatttggttgcgaagtgctcttaccggatgtcctgtgcttcttccggttactctggaatcaatgtccttcgctttgatgatcgcatttttataattttcatgtacgatagattcttcggtcgcaacaaaatgggttcccatctgtacggcttttgctcccagcataaatgctgccgcaattcctcttccatctgcgattcctccggctgcgattaccggaatcttcactgcgtctacaatctgtggaaccagtaccatagtcgtattttctccgatgtgtcctccggattcacatccttccgcaacaactgcatctgccccgcaccgttccattcttcttgcaagtgcaacggatgcaaccaccggaatgactttaattcctgcttctttccatattttcatatatttttccgggcttccggcgcctgtcgttacaacctttacgccttcttccgctactacttttgccacgtcctctgcataaggacttatcagcatgatatttactccaaatggtttatcagtcagcttttttgcttctctgatctgttcacgtacccactcagccggggcgcttgcagccccgatgagcccaagcccgccggcatttgatacgccggccgcaagatgatactcagcaacccaggccattccgccctggatgatcggatactcgattccaagtaattcggttacttctgttttcatattacaacctctttctgtctgtgtttttgcgattcttattttttcagtccttcgatgtatgttacaacacttccgattgtcttgagatcaccgattgcttccgtatcgatttccacaccaaattcatcttcaaatgtcataaccatatccatcagatcaagggaatctgctccaagagattcaaaagttgtctcctctgtgaggtctgctgcgtttacgtcaagtccttctgctacgatttcttttactttttctaacatgttcttagtctccttattgtttgattatttttatatttaccactctatgagtgtggctccccaggtgagtccggcaccgaagccgcagagaacaatcttctgtcctttgtggaagcgaccggttttgttcagttcatccaggaggattgggatgctggcggatgatgtattaccgtattcttcaatgttgaccgggaattttgcaaggtctgttttcatccgttttgccacagattcgatgatccgtaagtttgcctgatgcagaacgaaaagatcaatatctttctcggtcagatctgctttttgcagaagttctccgatgacttccggcactttttttacggcaaatttgaaaactgcctgtccatccatggatacataagtctgtttttcattttctttgtcctgccagtttttctgctgacggctttcgcaggcaagtacctgtccttttgctccgtcagaatgggtaactgccggaaagatttcaccttcttctgcacagatcacggctgctcctgccccgtcaccaaaaagaatgcagcttcctctgtctttccagttgacaattccggatagggtttcacttccgatcaccagaatgttctgatacattccggctgctatgtaagcctgcgcagtattgtaggcatacacaaaaccgctgcatgcggcactgatgtcgaaacaggttgcatttactgctcccagctctttctggacttcgcaggcagtgcttgggatcacggtgtttggcgtgattgtagataccaggatcagatccagatcgtctgcatttaattttgcatctgtaagtgcattttttgccgcttttatcgccatgctgactgttgtatcttcttctgcaatatgtctgcgcacaattccggtccgttcacggatccattcatcattcgtctccacaaacttcgcgagatcattgttgtcgtaataatgctccggtatataagaaccggtaccgcatatccttcctctcatggttgttctctccatttatttttgttttaaaatctttttcgtttaaaatatttttatattcaaactatttgataatataacataatcggaatgatttgacaagagggaaatttttttgtttgacgcgaggggcaaatgaatggaaaagaagagttcctgttctcttcttttccattcatctgccattcaaatcggtaaaaaaatgacgtgctttagtctctgtattttctgttctgagtacaaaaaaatcctgcggttttgccaattcaaaatcgcaggatttttcttattctgtaacttcctgatatgcctctttcgtctgttctccgctccggcggatccctgcaaacaaagatccggatatattatgccatacactgaagatcgcccccggaagggttgccagtggatttgccacgaaattggcagttgcaagggagattgcaagtccactgttctgcattccgacttcgatggcaatggcagttgccttatcgtactcaatatgtaaaattttcgctgcaccgagtccgattcccattccgcagagattgtgaagcatcacaactccgaggaccagaagtccgcagcttaagattttttctgcattgacggctacgattccgctgatgatcattacgatcgatacaactgagatcagtggcagaacctctgatattttctggatctgcttcccccagacccagttgatcagaattcccagaagtaccggaaccagaacaacctttactacagaaattaccattgcccagaaggatacctctacccaggctccggcgagtacatacaccagaagtggtgttacaatcggtgccgcaagagttgatgtgatcgtcattccgacagaaagcgccacatcacctccggcaatataggtgatcacattgcttgccgttccacccgggcagcaaccaaccaggatcacgccaagtgccagatctgtcggcagctgcataacctgacacaggatccacgcgatcaccggcatgatcgtgtactgtgcgacgaatccgatcaggatttcttttggtctggaaaagactcttttgaaatcgtccatcttgatcgtaagccccatgccgaacatggcaactccgagaaatacagaagtgtagctcgttgtccacgcaaagccgtcacgccagaagaatgcaatgacggaaaaacagataatgatgaccccgatatattttgtaagaaaagagctgacctttcccacttttttcattctgttttccataggctatacctcatagctgaaattgtcgattagccttgtttttccaatataaactgccatggcaaccagaacatctttttccacactctcgaccggctgcatatccagtgcatctaccatggatacatagtcgatctttgcaagcggctctgcttcgatcactgcgcgcatctttgacagaatttcttctgccttaattcccttgcagatcgcctcctgaccggttttaacggctcttgaaaggcacagtgcagcctttctctcttctgcgcttaaataggtatttctggatgatttggcaagtccgtcttcctcacggatgattgggcagcctacgatctggatatcaaaattcaaatcctgcaccatcttgcggatgattgcaagctgctgtgcatccttctgtccaaaataagctctgtccggtgctacaatattgaataatttggaaacaaccgtacatacccctttaaaatggatcggtcttgtctttccgcaaagggtatcagataacatatcaatacttacgtaagcatgtggatcatgatacatatccttcggttccggatggaagatcagatctgctccaaggctctcacaaagctcactgtcacgttcaaaatctctcgggtatgcttccaggtcttctgtcggtccgaactgtgtcggattgacaaaatcggataccacaacgatatcgttttcctcacggcatctccttatcaggcttgcatgcccttcatgtaagaatcccatggtcggtacaagacctatggtttttccttcttttttccagttcttaactaattttcttgtctcttcgactgttgttgttacctgcatgataattctcctctttataataaattcggagatagcctcttgttctgaattcaacaaatttcattttgtttttagattccttatttttcctggtctttcaacaacccatgtttttcataatttgtcacacggctgatcttattttcatcatccacgaaaacaacttttggtttatgttctttggcttcttctgcctcataatttgcataacacatgataataaccttatcacctgtacttacacatcttgccgcagcgccatttaagcaaatcattccgcttccacgcttaccacagatcgtataagtttcaaatcggcttccgttattcacgtccacgatctgaaccttctcatattccataattcctgctgcctccagcagttcctcatcaacggtaatacttcccacgtaatctaattctgcctgtactaccgtagcacgatgaatctttccttttagcatctcaactgtcatgtcttactccttttctgtccggaaacacaaaaataagcataaacatagagtgtaaccatgcttttttccataattccaaattattatatgaaaaaagcatcatcaaggtatacttctccctgcaaatgcttctgctattcttcgtattccctgagtcttattttacctcttaataaatataagctccttctccgtcacctgttgacggaaacgatttcgatatgaaattgttgtgattcagtcagagtatagttttgtagttttcaaatactacctccgcagatattattgcaccttgacaagagattgtcaatccaatgttctcatgtatttaattcaagacatctgtgcggaagatggggcgcaactcgtccggtggacgagtgctctgcgccgaccgtagcggagcgaagacctggaccctgggttcagggatcgcttcggtacaataaaagaaaaccttaagcaaatcatccgaggtttcttttattatgcggaagatggggcgcagctcgtccggtggacgagtgctttgcgccgaccgtagcggagcgaagacctgaaccctgggttcagggatcgcttcggtacaataaaagaaaacctcaggtgaatcacctgaggtttcttttattatgcggaagatgggacttgaacccacacgcccttgcgagcactagaacctgaatctagctcgtctgccattccgacacttccgcgtcaacaaaaagaatcttatcacataccaaccggtttggcaagtgttttttatattttttttaactttttttacatttcattaaattacatcaattattttgaatgcagtttgccgcatcaattgtaattaccagaagaagtcccatcaattcatctgccggatttgcaaaatccagtacataagtatctccccagtggagtaattcttttgtaatatgtaccacaggactgcatgcttcatagatatcataattccattccttgaaatctccttctacatgccatccattaaactcaacatcatacttcggtcgaaacaatgtaaaacgcttttcaatccgtccaagtgtctgcccattcacttcaatttcaaacactggaagtaatgacatcactttttctttaatcaacccgagttcgttccctgccatatcatatacatgcagccggtgtccaagcgacaaaaactctgcttttacaaaatacttcgcattttcattctcatcataaacatcatatgaatctgtccatgaaaaaactctctgcttaacaagtaatttcatacgctactcctactccggaaattcatacttcctcaattcgcagttcttaattccaaatgccgcaaactcttcattcgtcatatcataaaaataagactggattactctggaaattccattatgtgcaaccagtagataaaccttatcatccgcttctttccgaatatcatccagaagattgtaaatcctctggcacagatgaagcattgtctccccgccttcaaaatgattgataaagttctgttttgcctttttgaactcctccccatttctcggagtggactcatattttccaaaattctgctccttcaggcgcatctcctcacgcatcggaatccctgtcacctccgaaatatggcgcgcggtctccttcgcccggacaagtggcgaatacaggatctcgtcaatctttacgccctcttccttaatctttcttccaagctccattgcctgctcatgtccaagctctgtcagctcgatatctgtcgcaccacagattttattttccacattccatacagtctgtccatgtcttgtaaaataaaaatgtcccattattctttctcccagtacgctttatttgccgagcatttccggacaaaatgttccggtaaatgcgcataatgttttccaaaatgataggcaagataccgaaccgcacttcgcgccgccacttcacctaaatattcctccatatgattctgcttcagaagcgctgaagtcacacggaccagccgcattccttcttttccaggttttgtattttcaatcatctccggatgctccgcatgcgcaaccccgatatcaaagttacgcttccagagttcgcgcagattgtcattgcgataatacaggatctcagcctccggcgcataaaccgtctgccagcccttttccagaagtcttctcgccgcaagcatgtcctctccggcgatcatcctctttccaaagccttctgtctccagatacgcacttcttctgtacgctgcgcatacattagaattaaaaaatgtccggatcccaagctttccggtatcttccaaagactttgtcatacctttcggcggatagttaaactgtctcacacaacactcgatcggactacattcatcatctgtcatatgccttccatacacgaccgccgtccgctcctctttaaacggttctgtcagcttctctaccagatatcggttctgtggtatcgccgtctgtaccataaaaatcacaatatccgaatccagttcccgtaagatcgcatctctgcttcctgcccggtcatattcctcctttggagtatatcgggcttcaattcttttatccatatagatttccgggatttccctatcaatcggattctcataaagaacttcaagcaaaattctgtccggcattacactctgtctcaataatctctctatactcattttcagtcgtccatctggtcggaagactggaataacaatctcaatattcaagtcatcatctcatttcgtttttcttactaatcagtatatacaaattttttccagcttatatcctaatttacttacaaccattatgctgcatattcttcttttttcttcctgtccatcgcggaaagttccttaagctccctcaccatgaaatatccgcagacgattgctgctgccgcatctgcaattggtccggcatacataacaccgtcaattcccataaacaatggaaagatcatgatcagcggtaataaaaagagaatctgtcttgtcagggacataaatacacccagctgcgattttccgatggagttgaaaaagttcgatgtaaccggctggattccattgataagcgtaaggaacatatagatccggaaataccgctctgaaaactgaaaatacagctcacttcccgaaccaaatacgctgatgatctgtctcgggaatacctggaaacagaaaaatgcaattccggaaagaacggttgcagttccaagtgcgagcaggtagcttttccgtacccgttcatacttctctgcgccatagttgaagccgataatcggctggattccctgggaaattccgataacaaatgacataaagatcatatttacttttgtaatgatcccggcacaggcaagcggaatgtcaccgccatatacagactgtgctccataatgcgacaatgtattattcagtacgatctgtacgatcgtcattgcaatctggttaaagcaggcactggcaccgaatttgaaaatattctcgatatgtcttcccgtcatatggaaactttcctttgtaagccggatcgttttaaaatggaacatataccgcagactgatgcagaacgaaacgatctgtcctatgatcgtagcaagtgctgcgcccctcattcccatatgcagcccaaaaataaaaatcggatccagaattgtatttacaatagcacccaccagcatagatgtcatcgaataccgcggacttccatccgcaaggatcagcttactcatccccgtatttgcgatcagaaatggaaagccaattgccgtgatccgtgtatattcctgtgcatacggaagtacctccgatgtggcaccgaagaatttcagcatcggagtcagaaaaatcgtcgttactgcaaaaagtgcaatcccgaaaattgccatcaggcaaattccatttcccgcatactctgcagattctttttcttctcctgcaccaagcttcaatgaaaaattggtcgcactgccgattccaagcagcagtgagattgccgtacaggaagtagaaagcggaaacgcaatattcgttgctgcatttcccagcattcccacaccctgaccaatgaaaatctgatctacaatattgtaaagagctgttaccagcatggaaataatgcatggaatcgcaaatccaaccagtagttttgattccttttcatacccaagcggattgtcctgttcattcactgtatttgcctttttatctctcacctttatagcctcctccagatgttcatatataaatgccgctgtctcacttagtgtcatcgttccatttatccgctccgcagcttctcctcttggaacaagtacaaattcatctattacttgacgcattacaaaattctgtgttttttatacttctattccatcatctacaatttacatctgttttctgacgactctgtattcatctccagatctgtagtaaggacactgataatgctgatccgtcagaaaccgcatcatctcatcctcatccaggtctctgtcacacgtgtaacattcatattcatcatcgtaaatataaaatgtacaggtgtcacaacagctcgctgtatttgccataacctgcctcctgttatttcttttcctgttcaaaaatcggtatcagctgcaggtgtcctcctttaaaacaggttccatcttagttcattcctttttctttttctctcaccggcttcgcccagttgacaatcaggattccgatagaaaccagcaccagtgcgatcaggtctttcattccgaatacatttccctcacgcaaaatgatcgcggaaaggatcaccccgaataccggattcgtaaatccgaagattgataccttggataccggattgtatttcaacaggatcccccacagcgtgtatgcaactgcagaaatcagcgccatatagatcagaagaatcattgccggcatacttgccgtatggattcttccacccatcacgaatccgatcaggatcatcacgagcccgcctgcagtaaactgatatccgcttaacatcaccggatcagatttggctgaatacttcttgatcagtacagaagataatgcataagcgatcgcagagataaaaataaatccatctccggtcagattaaagctcatatccacattgcttccgctcagattgatcagaaccacccctgcaaatccgacgatacatccgagcacttttttctgatccagtttctcctgatgaaagatcaggcttgaaacaaggattgcaaggaatacattggatgcctcaacgatcgatcctttgactccggtcgtatgtgcaagtcctacataaaagaaaaaatactgggccaccgtctgtaaaagacagatttttccgattctcggaagatctcccttccccgctttcagaaaacgtccctgcaggatcgatccaaacaaaataaccataatgcctgcaatcgtaaagcggcaccctgcaaacaggatctgcgtggcggtatcggctgaatcgatctgaaacagccggtagccaaccttgatacaaggaaaagcacttccccataacgcacagcagaccattgcaagaagacataccacccaggttttcctcattgtagtctcttttaactttatcatctcattctttccgtttcttacgcaagcagttcatctgcaagttcttccattgcagttacatctgcatctttcatcgtagatttgatcgtaacagtcttttcgcagagagtgatcttcttcatcttttctacataacctttcatcacacgtgctgctgtcggagcccaggaaccattctcgataattgcgatcttacggttctggtagttcttattggtcagtttgttcaggaaagtctccatgcacgggaacacacttgcatcataggaagctgctgcaagaaccagcttgtcatagcggaatgcatcctcgattgcctctgccatatcatctctggaaaggtcagtgatcgctaccttctttgcacctttggcttccaggatctctttcatcttctctgctgccgtcttggtattgccatggattgatgcataagcaaccagtaccccgtcatcttccggttcatagctgctccatgtcatgtattttccgatatagtatcccagattttctttcaggatcggtccatgaagcgggcagatcgtctgaatgtccagagtcgctgcttttttcagaagcgcctgtacctgtgcaccgtatttgcctacgatattgaagtagtatcttcttgcttcacaagcccagtcctcatctgcatccagcgcaccgaatttaccaaatccatctgctgagaacagaatcttctcagacttttcgtattcgaccataacttccggccagtgaaccatcggagccataaagaactgaagggtatggcttccaagggaaagttcttcaccttcttttaccgcaactgcacggtctgccagatctgcgatttcaaagaactgtggaagcattgcaatagcttttgcacttgccacgatcttggcttccggatatttgtctgcaaattctttgatgcttccggcatgatccggttccagatgagatacaaccagataatccggtgttcttccatccagcaccctctccagattctctttccattcgtctgtctttctcgtatcaatcgtatccataactgcgatcttctcgtccaggatcacataagagttgtaggatactccgtttggaacgatgtactggctctcaaagagatccagatccttatcatctgctccgatatattttactgcatctgaaattactatgtctttcatgttagttcctccttgtaattggtgattgaaaagattctccggcacatagtgtcttttattcggcaggaagttcctacggaatttcctgttaaataagaaagctggaaatattacattccagccctcttaatttccactcttaataatactatggaaataacacactttcaataaaaaaagcgtttaattttttcatatctgttctcattttttacgttaaccggcacacaccatctgttcctgctcgtaaatgtgaaacggcgcatcaatcggatttttcatatcccagagataatatccaccctctttataatacaccggaagagtctcgcatcgttttacactccggatcagttcctgtaccgaacggatctctcttggaaaatacgttgcataaattcccagcttctccggcacatggcaatcacttgatccaactgttgcaagtccaagctcagccgcatattctgccgcctttcgatttgcctcataaagtgtgctgccgttcagcacttcgattccatcaagtccctttacaatcttcaggttctcttccagtcccctgttattattgcggaatggatgggcactgaaacacataccgccctgtgcctgtaccagatctacaaactcctgtgccgggattctctcttttggataatcctcaattccaaatgctacaatgtctccctgcagggaataaaattcaatcccgacaaaaatcggaaatcctgttttctccgaatactctgccgcaaattccttcagtcccatactgtcatgatccgtaatacagatcccatcaagtcctctgcgctttgcgatctctaccatgttctccaatcttaaaaagctgtcccccgaataacgcatctcatgcatatgcatatcaattatcaactgttaataacctcctgttaaaatgccttttcatttctcttttcttcattttaacatgttgttttacaaaaaaataattgataatttacatgcagaaattcaattataggtttttccgataaacactctgttgctcaaatatctgcataagatgcacacaaagtccgtcccacgaaatctgctccagatgctccttttccggctttgatccaggatattttgcgatcccttcaatggctccggcaagtttcttttcaaataccggaagttcttcttccacaggttcatcttcattcactctttttggcggctctacaaaaaccacaccattatccggaagattctgatcaatccaattcctgatccccggaagatctgtacagatcacataggtaccacatgccagagcctcaatgatcacaagtggaagaccttcataaaaagatggcagtacaaacacatcactctgattcatcttcttcgccaactcctgctgtgtgatcttcccggcaaaggtaactgcaaacggacacttttcggcaagctcccggatttcctgatattcgccctcatccccggcacctcctgccagttccagagaaataataagaccggaatccttcagataatccaacgaacggatcagacttttcacaccctttttctctgaaatctttccggcaaagattagtctcagctctttttcttctccctgtgaagtccccatctcctgccggaaaacatcactgttatagccggttccgatcacccgtaccttctctctgatatgctccccgtaaattccgcagatcatctctttctgctcctcatgcaatgcaaaaatcccatccagcgcaggaattctctgtaaaatgtattcccggttctgttctgtcttgcggatctgccgcaggtcggatccatgggatactccatatacctttttatcaggaaacagctctcttacaatcgctgtaaggagatacagatgatgacacaggatcacgtccggatccaactcctccactgcctttttcagtacctcgccaaatgcgttccggaacgtttctgtcatctcctctgtcaggtctgaatacctggtactcggataaggcatctcgtccgacattcccgtgatcggatacggtaactgctccgattcaaaatataccggataaaagcttaccccctccggaagacatacctgatcagcttttgtaactcccgcgatcactgactgggtgattcccttttttttaaatcctctgaccagttccgtcagatagataccgcttccggtactgtccggcttctgggctgtgacacttaatattttcattctttcgtccctcttactttgttaaaatttccctgttacatgtatttattgccgcaatgtaatcaataaaagcggtactcaccgtttatcatttatccatgctttaattattctccagtttctttttcacctgtttttttagaagttcttcctttcattggatgaaaatgttccgaaaggagaatgcttttgaggattgcgagagtgcaaagcacgtagcaatctggtatcaaaggagcaaaatacctttggaccccaacatcttcatatgattatattaacatatagttggaatctgtaaaagagacgatctcgatccggatattttcaacagaaatatctaaatactgcttcttctttttccgctttttccttaaaatccataaaaaaagcaaaaaaagaaacctttttggtaaaggttcctctattacttctatatataactggttttgttatgtttaactaaatgcggatgacaggacttgaacctgcacctcgtagagactagatcctaagtctagcgcgtctgccagttccgccacatccgcatttttttagtcccacagaaaaccatgggactaaataagtgagcgtgcggggattcgaaccccggacaacttgattaaaagtcaagtgctctaccacctgagctacacgcccgtaactgggccagctggattcgaaccagcgagtgcaggagtcaaagtcctgtgccttaccgcttggcgatgacccattatctttatgtcttaacatagaatgcgccatggcacattcccgcgcctgcgacaatcgcttaacttatggcatcccgtattctgccaaagctctcatatcctgccggagacttttatgatatccactcttacaatgtctatcataaaaaaaatgcgagcatttctgcttgccatttctttcaaatattataaattaaagggtggatacagggattcgaaccctgggcctccagagccacaatctggcgcgctaaccaactgcgctatacccaccatataaacgtgcttggagggattcgaacccccgacccacggcttagaaggccgttgctctatccaactgagctacaaacacacaacactggattctcagtgtaagcgggtgatgggaatcgaacccacgtatccagcttggaaggctggtgttctaccattgaactacacccgcagatcacatcggggtgacaggattcgaacctgcgacctcctggtcccaaaccaggcgctctagccaagctgagccacaccccgttgtttatctgtttgtcatctccgtgacgacaaaagttattatattacaaggttttcaaaaagtcaacatgttttttgaatttttttaaagaaatttttatttttctttttcttgtaaaagacacgcatttttgcccttttttcagcagaaatacgtgccacctactctaatccagataatgaatcgtaaactccgtattcccgtcccgatccatctccataataatataactgccttttctgccttcctgccgtggaaatgccagactgcccggattcagcactgtaatatcaccaaactttttcagatacggtctgtgtgtatgaccaaacatcacgatatctgcatttctcgatcttccctcatccaggatccgctctacaccaagagacaccgaatactggtgtccatgtgccataaatgcttttttcttgccaaaataaatctccatctcccggagattgcgtgagaagaaatcattattcccagccagtatatacgccggacatccgcagaatgcctcaatatagtcttctccgccctctgtatccccgagatgcaccagataatcaatctttccagcttccatgattgcccggtcaaatgcagtatgtcttccatgtgtatcactaataatcaatactctcataactttttctccatgatctgtctcatcatccgaagtgcttctcctctgtggctgagttcattcttcttttccggtgcaagctctgccgaggtacaaccatattccggcaggaaaaagatcggatcgtagccaaatccatttgctccggcgatttcgtaaccaatacatccttccatcgttccacggacaacctctttgtccccgttcgggaatactgccgccaccgcacagacaaaccttgctgtacgctgcttgtccggtacgcccttcattcttgaaagcaggatgctgttcttgatatcatacgaagtattggttcctgcatagcgcgcagaatagattcccggttctttattcagataatcgatttccagtccggaatcatctgccagcacaatcgcatccatcgccctcacttccggcagctctgcgatcgctgaggctttgatcatcgcattttcctcaaaggactttccatcctctacgatatcaatgtcaaccccggcttccttcatagaaaggatctccatccccagatcccgcaagatctggcggatctctgtcattttattcttattacccgttgcaaaaataattttcatctgtaaattcttctttctcttactgttttggttcttttgggcgtttcggtggcttcggacctaagaactgataaaaataggtcttcagcataccattatatatcttccggttcttatctgcttttcttccgaaataacgttctgcatcctcgtaactggtgatcatatatgcagaccagctatccagctttttaaaactctcaccaaattctctgtataactgcggcagatcctttttatcctccagtcgctcgccatacggcggatttgtaatgataaagccatacttcttcgggtggcttaaatcctttaccgctctttcctgaaaatggatcagatggtcaacgcctgcatctttggcattctgtcttgctgcttttactgcctccggattcaggtcatatccctgaatatcaacctgtaccttccggtcgatcacatcatttgcctcatccattgcatcataccatgcctttttcggaatcaggttcacccattcttctgctgtaaaggaacggttcatccccggtgcaatattagctgccatcaaagccgcttcgattggaaatgttccacttccgcagaaagggtctaccaggatccggtccttgtgccacggtgtcagcatgatcagtgcggatgccaatgtctctgtgatcggtgcctttacggtcatctgacgataacctctcttatgtaaagatacgccggaggtatctatcccgatcgtcacgatatctttcatcagaaatacacggatcgggtaagctggtccatcctcctggaaccattctatcccgtagatccgtctcagcctttctaccatggcttttttcatgatcgactgaatatctgacggactgaacagcttactctttacagatgcagccttcgtcacccagaattttccgttcttcggaatataattctcccacggaagtactcttgttttctcaaataattcatcaaatgtctctgctttaaacgaaccaaccttaagaaggattctttctgctgtccgaaggaacacgttcgcatcgcaaatcgcctgtgcatctccccagaagcatactcttccgtcttctactgttgatatctcatatcctaaatccagcacttcccgcttcagaacagcttccattccgaaatggcagggtgctatcagctccattttttccattctttttcctttctctactctgcaatctgttataaactatattacgtttttcggttgccttttgtcaagtagtgcgcttgtaccacaaattttttaaggaaccagattgctacaccaaaaacagaaaagcagcggaatccaaaccgctgcttttccattcttaactgctttgcactttttaatacttatcactttcgttatggcaggactttgagctgtcatatgcattacggtctgattcatatgcattctttgcattccggttagtcgtatttttaccggatgcatttttattgcctgaatttttatttgactgattcttgccggaagcattttcagcatacgcattcttattggatccatatgaatttttgtttgtactgttttctgaagcattataattttttgccattgataattcctcctgacatttttttgtacaaacatagtatctatccttttcgtatttttatacatttttatttttatcttgatttttaaatcggtttatattatactttgtcgtgtagagatttattttctacaaccccttattaattatttatactcccctcaaacgctcgatagctcccctatcgagcgtttaacgttatataacaggcagatcctttttaagtacttgaacctgccatatagaacatataatcaaaaagccggaggcataagcttcttttcattgcagaagaatcttatacatccggcttttttaattaccatcgccttctcagcattctgaccagcagtatgatcaccagaagaggaatcagtaccggtgcgatcaggcttacaatcccacttatcaccgcaaagatcacaacgatcacagccacagccacaagaatcagcagaagtctcttccaccagctgtccaggctccacacatggatattgctgctttcttctgtgctgctgttgcctctgtaggtccttccatccgaatcatagatcacatcttctacactttcttctctctgcgcatccacgatcgtcttcgcaagaatccacggatctccaagttccgccagtacctcactctccgttcttccttttcggatctcatcatcaatatactggccgtagtagttcagattctcctgcagcacctgtggtgtcacaccggaagaaagttcaattctcagtttttcaaggaactctgctttcgtcatctttctttctcctctattctcatcatttcattgtttataattatattctgatgataccagggtcaaaagatcagaaatccaatgcaagcttgcttgcaagaggatttttgacctcttgacccgccaaaaacatgagtaagtagccatttttcaaagaaaaatgagcggattacgaatgtttttgaggattgcgagagtgcaaagcacgtagcaatctggtatcaaaggggtcaaaataccttttgaccccaacatcattctgatacaaaaatgcgcctgtgatcattacccgcaacatcttccctgtatcacagtgcacatcccgccggaggctttctatatccggaaataaatttccggatatagaaaagaacctcagacttagagtagcataatttctgcttctttccaagtctaaggtccttaaatttctataagaattttatatgtattttctaaacttcaaataaaagatctccgtaagaaggcattggccatacttctttatccacgatcatttccagttcatctaccggtgtacggagtccttccatagccggaactacgctgaagtgatagaattcagactgtacttttccttcttcttttcctgctgcttcttctgtgactgcttccagtttcttaagggcagcctttgtttctgtcagaagtcctgagatgtcagcaagcatttcagcctgtacagatgcatctgctccggcttcttttactgcaagaaccgtatctgcaagctcttttgtatattttacaactgcaggaatgatctgttttgcagcaatatcgatcatggcctttgcttcgatattgattgcctttgcatagttctcgtatttgatctctgcacgggattccagttctgccttggtaaatacactaaattttccgaacagttctaccgctttgtcagttgtcagtgccgggattgcttctaccatggacttgatattcggaagtcctctcttttctgcttcagctacccattcgtcagaatatccgttgccgttgaagataattctctgatgatctgtcagatattctttgatcaggctgtgtacagctgtatcaaaatcatctgctttttccaggacatcgcatgcctctgcaaatgcctctgctacgattgtattcagtactacgtttggtcctgcaatggaatcgcgggaacctaccatacggaattcaaatttatttccggtaaatgcaaatggtgaagttcggtttctgtcggttgcatcctttgtaagatccggaagggttgttacacctgtttgcagctttccaccattcaggctgtgtgttgcctcacctgtactgagaagctgttctacaacgtcctgaagctgttctccaaggaagatagagatgattgccggcggtgcttcgtttgctccaagtctgtggtcatttcccggatcggcagccgattcacgaagcagatctgcgtgtacatcaactgctttcaggatacatgccagtaccagaaggaactgtacattttcatgaggtgtctttcccggatccagcatattgattccgtcatctgttgtgatagaccagttgttatgcttaccagatccgttgactcctgcaaacggtttctcgtgaagcagacatttcagtccatgctcgcatgctacctttttcagtgtcttcatgatgatctggttgtgatccactgcaatattggcctttgcatagatcggtgcaagttcgtgctgtgcaggtgccacttcgttgtgctgtgtcttcgctgcaacgccgagtttccataattcttcgttgacatctttcatataggaagcaaccctctgacggatcgttccaaagtaatgatcgtcaagctcctgtcctttcggcggcattgctccgaaaagtgtacgtcctgtgtaaataaggtcttttctctgtaagaatttctttgcatcaacaaggaagtattcctgctccggtcctacagaaggtgttactttctttgatgttgtatttccgaacagacgaagcagtctgatggattctttgttgattgcttccatagatctgagaagcggtgttttttcatccagtgcctcacctgtgtaagagcagaatgctgtcgggatgcaaaggatcgctccggctgcatcttttcttacaaatgccggtgatgtacaatcccatgctgtatatcctcttgcttcaaatgtagcacgaagtccgcctgacgggaaagaagaagcatccggctcccctttgatcagttcttttccggaaaagctcatcagaacctttccgcttggaagcggagctgagatgaaggaatcatgcttttcagcagtaactcctgtcagtggctggaaccagtgtgtataatgggttgcacctttttcgattgcccattctttcatctcatgtgcaattacatctgctgtctcaagatccagctcttttccttcttcaattgtctgttttaattttttgtatacttttttcggaagtctctcctgcattactgcatcgttaaaaacatcttcgccaaaaatttctgccacgcttaaccatccactactcataattaccttcctttctctaacgcaaaaaaacgaggaagctccactttgtggaacttcctcgttcattgtgatctctgttatttaagatatatttacgatactcttttttctttcaaatttcaagaccaattttttaatttgtgtatattttcacaaaacttcataagttttcaacttctttttcaacacttataccagtcacttcttagacctcgaacagcagatctccgtaagaaggcatcggccacatattcttgttgacgatcatttccagttcatccactggttttcttaaagcttccattgccggtacaactttctgcatgaagaagaatgcctgttcttttccttctgtctccggtacttctgccacaacagtttccagtgctctgagtgcttcttttgtgtctttcaaaagatcagccgactgtacaagaagttcttcctgtacacctgtatatgctgcagcgcttgcctgttttacctggttgatcgaattagccagcgaagttacatattggatcacagccgggataatatgcttgcttgcgatatcgatcatggaacgtgcttcaatgttgattgcctttgagtatgcctcatatttgatctctgcacgggattccagttctgcacggctgaatacatcgaatttttcaaacatttcaaccgcattgtcatatgtcagacattcaatagactctaccatggtcttaatattcggaagtcctcttctttcggcttccttcacccactcatcagaatatccgttgccattgaatacaattctctgatgtttggatgcatattccttgatcagatcatggactgcaagatcaaaatcttctgctttttcgagtacatcgcaggcatcagagaaggactcagccacgattgtatttaatactacgttcggtgctgccaccgagtctctggatcctaccatacggaactcaaatttatttcctgtaaatgcgaatggtgaagtacggtttctgtcagttgcatcctttgcaaaatccgggagcgtacttacaccggtatgtaatttgccgccttttaagctgtgtgcagcttctccggtatcaataagctgtgcaagcacgtcttcaagctgttctccgaggtatgcggaaataattgccggcggtgcttcatttgctccaagtctgtgatcgtttcctacgtcagaagcagattcacggagcaggtctgcatgcaggtctactgcacggagaatacaggtcagaaccagaaggaactgaatattatcatgaggtgtctttcccggatccagaatgttgatcccatcatctgtaaccagtgaccagttattatgctttccggaaccatttacaccttcaaacggcttttcgtgtaacaggcattgaagattatggcgatatgccactttcttcagcgtctccatgatcagctgattatggtcaactgctacgttgcactgtgcatagatcggcgcaagctcatgctgtccaggtgccacttcattgtgctgtgtctttgcagctacacccatcttccagagttcttcattgacatcagtcataaatgctgcaattctctcacggatcgcaccaaaataatggtcatccagttcctgtcccttcggaggatttgctccgaataatgtacgtcctgtaaatacaagatcctttctcttaagatatttttctctgtctaccaggaaatattcctgctcaactccaacagatggtgtaaccttttgggacgttgtgtttccaaaaagacgcagaagacggatggattgtttgttgattgcttccatagagcgaagaagaggtgtcttctgatccaatgcttctccggtataggaacaaaatgctgtcggtatatataaaatcgatcttttcccatccggactctttttaacaaatgcaggcgatgtacaatcccacgctgtataacctcttgcttcaaatgtggaacgcagtcctcctgacgggaaggaagatgcatccggttctcctttgatcagctcttttcccgaaaactccatcaggatttttccatctgacttcggtgctgaaataaacgaatcatgcttttcagctgttgctcctgtaagaggctggaaccagtgcgaatagtgagtggcacccttttcaatcgcccactctttcatctcatgtgcaataacgtctgctgttgcagcctgaagctctttaccttcttcgatcgtctttttcagctctttgtaagtcttcttcggaagtctttcctgcataacagcatcattgaagacgttttctccaaatatttctgctacactaatccattcgctcatcccatgtacctctcttttctactactcattttctactactcatacaaaacggtcgttttttgattcaaataaaggagtcttgcactcacgcaaaactccttttataccgttttcttcggacgcctttgtccatgatattatcaaaaatcagactattcagcttttccgtcagaaccgaacagaatcattttctcttttactttttcaacgattgcatctgcacccggtttcagaagtttacgtggatcgtatccttttccttcaagatcctttcctgcttcaatgtatttgcgggtagcttctgcgaataccagctgacattctgtattaacattgatcttagaaactccaaggtcaattgctttcttaatcatatcatccggaattcctgtacctccgtgaagtacgagcggaagttctcctgtgagctcctgaactgctgcaagagtctcaaagctgagtcctttccagtttgccggatattttccatgaatgttaccgatacctgctgcaaggaaatcaacgccaaggtctgcaatcatcttacattccttaggatctgcgcattcgcccattcctacaacaccgtcttcttctccaccgatagaaccaacttctgcttcgatagaaagtccttttccatggcaaagtttaacaagttctgtagtcttctcaatgttttcttcgatcggataatgagatccgtcaaacataactgatgagaatcctgcatctatacatttcaggcagccttcatagctaccatgatcaagatgaagtgcaaccggaaccgaaatgtccatttctttgatcattccatttaccattcctacaactgttctgtatccagccatgtactttcctgcgccttcagacacaccaagaataaccggtgatcttaattcctcagctgcagtcagaactgctttggtccattcaagatcgttgatattaaactgtcctactgcataatgacctgcttttgctttttttaacatctctgttgctgaaactaacattttgtattcctccacttctctgttaaaggcttttataggctgacccccaggggaatcgaacccctgattcgaccgtgagagggtcgcgtcttgaccgcttgaccagggggccagatgtatgttcattagctgtctggctaactcacttgcttagtataacgtacttcttttcatttgacaagacctttttttatttttttactgttcctcttccggaactacgattttaagcgcctgtttcgcgttcttgatgcagacactatcgtgttccccaccgaactctccatccagcgtccatgggatctcttccactgattcaaaatggatctcacctgtcttaaatgaataaatgtgcttcgtattgatctggctgctcagaagcgccccaatgatctcctgaagcgcgagcgggttcttcggtgtccggatcagggtaacctcaaattctccgtcatcaaaaaccacattcttcccgatcatattacggaaaccgccaacagatctggaattcgtcaccataccataaataaattcgtcctcaatcgtttctccgtcatgtgtcacttttaatttatatgacgggatatcaaaaattctggttgctccttccagcacatatgccagatgtcccagaacattcttcatttcctgctttgtctcataagatacatccgtgaagagtccgaatgctgcaatgtacacgaacacatctccgttaaaccgtccgatatcacagggaaattcttttccccctgcagctgtacttgccgcctggagaagattcttcgggatatggagactgctcgcaaagtcgttggtcgttcctgtcgggatgtaaccgaccggaatctttttttctctcttcatcattccggttacgacctcatcaagtgttccgtcaccaccactgcagatcacacggtcatactcctctgtaaatgtctttactttataataagcgtctttatatttctgcgtcggatatacaaccacttcatatcctgcttttacaataatgtcaataatatcagaaagcttcggttttaaaagtccctttcctgcattcggattataaataaacaatgcttttttcatacgtccgtcctcctgttatctgtttttttctctataagggctgtccccacagctccttacggatacatgcattatagcataaagagcctgctttcggcagactcttcaaagttttatgcaattatctgttcttaacgttcacaagaaacctttcgataccagctgctgcttccttttcatctgttccgttcgcaacaacggtgatttcctctcccggcatcagtgtcagactcatcatccccataatgctctttgcattgacttgcttctggtcaacttcgatatataccgaacttgaatactgactagcttcctgaacaagaagtgcaatcggtctggcgtctaatccctcggacaattgaatcttaacaggttttttgatcataatgttcctccttgcttagcccttatctcttccgccatttcacttaacttgcgcaatctgtggttcactccggacttgcctaccggattttgcagaagtgcgcctaactcttttaaagatgcctccggatatgtaagtcttgtaagggccatgtccttcaatccttccggcagcttatcgagtccttttgtttcctcaatataccttatatcgtcgatctgctttacagcagcggaaaccgttttattgatattcgcagtctcgcagttcacttttcgattcaccgtattcctcatatctttcaatatacggatattctccaactccatcagtgactgatgtgcctccatcacattcagcacatccacgatctgagctccttctttcagataaaccacaaatgatttcttccttgatacaatctttgcgtccagagcaaagcatctcattatcttctgaatctgctgcgcttttcccatcgacgcacagacaatttcaaaatgataggacttctccgggtcgctcatggatcccgatgcaagaaaaacgccacgcaggaaagaccgcttacagcaagtctcctgaatcacgacattctttactacagaaagctcttcttccacgtctccataaggattgagcagttttgccgcctgaagcaccctgatagcatcttcgtgtttttttacaactatataatagtagctgctgcctttttcccggttcacccgaatagcgatatcaaccactatattaaacgttcttctcaataaagtaaagctttttcttgcaactgccagattttccgtatgaatcttaagtgctgcatgacctctgctgtcgatcatgacagccccgcacatgctgatgatcgctgcaagttctgcaatctggcaatgtcttgcaggacttagctgacgcgatatttcttctttaatatttccagaaaaagacatactatcacctattttgctttcgtaattgcatctttctcgatatcacgatgctcttttcttacaccgtactctttctctgccacagacagccgttcatacaactcattggcaagtgtcacggagcggtgttttccgccggtacatccgattgcgatcacaagctggttctttccttctgcaacatagttcggaatcaggaactcaaccatgtcgaccagcttcttcaggaattcttttgaaatatcgttattcatcacgtaatccctgaccggcttgtcattgccactctgcgggcgaagttcatcaatataatacggattcggaaggaatctgacatcaaataccaggtctgcatcactcggaattccatatttaaatccgaaagataacacagtaatgtacagattcttgtattctttattctcggcaaaaatacggttcagttcactgcgcagctccctggtcagcatccggcttgtatccaggatataatctgccctttcttttaaaaaggcaattttcttacgttctttggcaatcccgttctcaattctgccgccctttgagagtgggtggttccttcttgtctctttatatcttttcaccagtgtatcatcattcgattcaaggaaaagaatctccagtggtatcttggttttttcaagttcgtccaaaacctggtccagtgcacgcagattctgtccactgcgaatatcaagtcccagagcgattttcgtgatctcaccatttggaacgatcaaaagttctgtcagttttgtcattaaaggaatcggcatattatccacacagaaatatcccatgtcttccatcattttcaaagttgtacttttccctgctccggacattcccgttacaattacgaatctcatccctaaaattctcctatttgtttcacttccggttccatcgtaacaccggtatcttctttcactttcgctgttacctgccggatcagctccatcacatcagccgccgtcgcatttcctttattgatcacaaatccactgtgcttttcagaaacctgtgctccacctactgtaaatcctttcagaccactgtcctggatcagttttcctgcaaaatatccttccggacgcttaaaggtgctgcctgcactcggacactccagcggctgcttcgatacccgcttctgacggaggtcatccatctgcgcttttatttcttcttttttgccttctgtaagcgaaatcacggcacccaaaacgatatatcttttctccgggataatgcttgtacggtatccgagtcccagttcttctgccggaagctccatgatctcgccctcttctgtcataaccctgacactcgtcagtacatccttcatctctccgccatacgcgccggcgttcatcacaaccgctccgccaagcgttcccggaatacctgctgcgaactcaaatccggtcagtgctgcatcaagtgctgcatttgcaatctgcgcaagcgaacatcctgcctgcgccgtgatctgatttccttctacctgaaatgttcccatactcttataaagctggataatcgctcctctgaagcctttgtctccaaccagaaggttgcttccatttcctactatatatataggtatcgaaaattcccggcacacccgaattgtctctgccagttccttttcattcgatggcatgataaaataatctgccggaccaccgatccggaaggttgtatgcttcttcatcggttcatccttctgtattttggctgcatcgaccacattatacaaacatgtctcaaaattctgttccattctcttctcctagtatctataaatattctatgccattcttctctttttatttaacaggaaattgccattggacctcccgccaaatagaagttactacgtgccaaagcacgttttaatatcatcctcatatgacgtaagtgtcaaaaataaattttggcacttacatcatatgatacaccaaaaaatatgcaagttcaacgcgctcttgcaaaattaagtgaaatgcgatatagtaaggcataacatagaaattttatcaatattttcaaaaaggagtgatttttaactgtggactcgagtgtctcgcaaatacttattttgctagtcctgctgctcttatccggcatattttcgtcagccgagacagcacttacaacctacaacaaaatccggatgcgtgcccttgcagacgagggtaacaagcgtgccagcgccgtacttgccgtaactgagaattcaggtaaaatgcttagcgcgatcctcatcggcaacaacattgttaatactgcggtagcttcccttgccaccacaatcgcataccgccttggtggaaccgccgtcgcgatcgcaagtgggcttatgacgcttctcatcctccttttcggagagattactccgaagacgatggcaaccattcatgctgagaagatgtctcttttctacgcaccggttatcaatattttcatgaagatcatgactccgtttatcttcattgtaaacggcctctccaccggtcttctgatgcttcttcgcatcgatccgaatgccaaagacaataccatgaccgaagctgaactccgaagtgtggtaaatgtcagccatcaggacggcgtgatcgaatcagatgaaaaagagatgatctacaatgtgtttgatctcggtgatgccattgccaaagacgtcatggttccccgtgtcaacgtaacttttgctgatattgacagcagttacgacgaactgatcgacctgttccgggaagacaaattcacccgtcttccggtttaccaggagacaaaagataatgttgtcggaacgatcaatatgaaagatcttcttctttatgacagtaagaaaagtgagttccagattaaagacattctccgtgaagcctacttcacttatgaatacaagagcatttccgagcttcttgttgaaatgcgccaggcctctttcaatatcgcaattgtcctggatgaatacggtgaaacatccggtctgatcaccctggaagatatccttgaagagattgttggcgaaatccacgatgaatatgatgagaatgaagaagaaaatatcaaagcggtaggcaaacacgaatatattattgaaggttctaccaatcttgacgatctcaatgattccctggatctgaatctggaatcggaagattatgattctctcggaggctttatcatcgaaaagctggatcgtcttccaaaagccggtgactctgtttccaccgaagacggaatccgtatggtcgtagaaaagctcgataaaaaccggattgagacagttcatctgtatcttccggagaattaccgcgaacatacgtctgactcgttggaaactgacgcctaagcagacctcccgggaagaaatcctgacagattttttctttatattttgcaggatatacaataatttcagggcagcccaaagtggactgcctttttctttttcggatttcgttattttttaaacaatttttttaagaaatattggttttttattgattttattgcgtaattatgtataattatggtaaatgggtgaaggattttacttcatcagatgataaaatctgcgctcacagcttttatcatttaaccatttaactagaattaggagaaagaggttaattgcaatggcagaaatcaatttaagcaagtatggtattactggaacaacagaaatcgtgcacaacccttcttacgaattactgtttgaagaagaaacaaaagcaggtcttgagggatttgaaaaaggtcaggtcagcgaacttggtgctgtgaacgtaatgacaggtgtatacaccggacgttcccctaaagacaaattcatcgtagttgatgaaaactctaaagacactgtatggtggacttcagacgaatataagaatgacaaccatccggcttcacaggaagcatgggaagctgtaaaggagatcgccaagaaagaactttctaacaagaaactttatgttgtagatgcattctgcggcgctaacaaagatacacgtatggcaatccgtttcatcgtcgaagttgcctggcaggctcattttgtaacaaacatgttcatcaaaccaacagctgaagaacttgagaacttcgaacctgacttcgtagtatacaacgcttctaaagcaaaagttgaaaactacaaagaacttggacttaactctgaaacagctgttttattcaatatcacaagcaaagaacaggttatcgttaatacatggtacggcggagagatgaagaaaggtatgttctctatgatgaactactacctcccacttaagggaatcgctgctatgcactgctcagcaaacactgatctgaacggcgaaaacacagctatcttcttcggtctttcaggaacaggtaaaactacactttctacagacccgaagcgtctcctcatcggtgatgacgaacacggctgggatgacaatggagtattcaactttgaaggtggatgctacgctaaggttatcaaccttgacaaagaatctgaaccagatatctacaacgcaatcagacgtgacgctcttctcgagaacgtaactcttgatgctgaaggaaaaattgattttgctgataagagtgtaacagaaaatacacgtgtatcttatccgattaaccacattgaaaatattgtacgtccgatttcttctgcaccggcagctaagaatgtaatcttcctgtctgcagacgctttcggagtacttccaccggtatctgtactgacgccggaacagacacagtactacttcctgtctggattcacagctaagcttgccggtacagaacgtggaatcacagaaccgacaccaacattctctgcttgcttcggacaggcattccttgaactgcatccgacaaaatatgcagaagaacttgttaagaagatggaaaagagcggagcaaaagcttacctcgttaacacaggatggaacggaacaggaaaacgtatctctatcaaagatactcgtggtatcatcgatgcaatcctgaacggagacatcttaaatgcaccgaccaagaaaattccttacttcaacttcgaagtacctacagaacttccgggcgttgattcaggaatccttgatcctcgtgacacatatgctgatgcttctgaatgggaagaaaaagctaaggatcttgctgcaagattcgttaagaacttcgctaaatacgaaggaaatgctgctggtaaagcacttgtatctgctggaccgcaggcttaaatgcaaaattagaagatggatgtgggagagtttctcctgcatccattttttgtgtatacgatgagccaagtgcagatttgtgcttgcacaaggatctgcatttggcgaatgtacatcatcgagctgtcaagcgagatggtgtacaaagtataccaatcaagtaggcgtcagcttactcgattgtgcgaagggacgagggagaggctgcaataacctcatctgcttcgttgcactgaccactccgatgagcctcttaggacgaaaattgtgtcagcaatggcttccacaatttttgagtctcatctccgtagtgcaaaatgtcagcagacgagattattgcagcctctccctctggtttttcaagacaaaacagaatggaatgatttatgagaaacagaacccacagccatcttcgggctgtgggttctgttgactgttgaagtttgttggttgcagatattcctttcgtacttttaaagtatgacgatagtgtaatatcaactacatgtatttatgtaaaataattttttctgcagtatatttctacttctcttccgggggaagttcttcaccggctagttttaagatgttgctgatctcatcttcggtgatgccggcgaattcttccagctcgtctacgctgacttttcggccgagttcatcggaaagttttttgatctgttcatcaaggtcgttgactttttctaccatgcggttatcttgttttttagtctcttcctgagattcaagaagtgcctgcatgctttcttttgccatgcttaaaagggcttcggtttcatctgcatggtcttccatggcgagcatgagtcccatgttgccttcctggacgagatctccgatgtagatatctgccctgtgcatctcttttgccatggtgaggattgccggtaggagttcttttaatggatccccatctcttaatcctttcagatcctgctcgtaaaggtttaaataattctgttcttcctgggtatatcggatcggttcttcggtgttttctgcatttttgatcgaaccaccggctttgacgtagccttttacgattactttcttggaaagaagataatcaaatacaagctccatctgttctgctgataaattgtcttctgcgaagtaagcttcgactgtggctttgtctgtgatgttattctggctttcacacagggtaaggatccctgcaagtttttcacgaaattctaatctttctgccatattttgattctcccgattctataatatatgaatatatttttcttgttcttccggtcaagaaagacaagaaacgtaatcaacaaactaatgattgctttcctgtagcatatcgctacaaatctatcataacattatatttcctacctgacaatttatttttctgcaatctggtatcaagagcaactaaatgctttttgtctgattgttttgttcgatatattcagctattttttctaagagatatgtgccgcctgctatgattgtgatacctccgatgattccgatgataaatggtgccataactgtcattccttccgtttttgtttatgtgggtttcttttgacagttttattgtattaaatctacgggtgcagaactatcatggttgatttaaatgtttgttaaatcagcacgcagcatatttttcttaatcgatttctcattttcacttttcaggatatccgacatatattatataaagttcattttttgaggtatatctatgcctgtatctatcatgctcgatgccggtcacggaggacgtgatccgggagctgtgtataatggtcgccaggaaaaggatgatgtactgaagctggtgcttgcgatcggagaaattttacaaaacagcggaattgatgtggaatacacacggacaacggatatttatgagacacctttccagaaagcaacagaggcaaatgaagccggtgttgatttcttcatatcgatccaccggaattccagtcctcttgccaatcagtacatgggcgtggaaagcctgatctataacctttccggcatcaaatatgagatggcggaaaatatcaatgcacagttggagacagttgggttcaaggatctcggagtaaaggcgcgcccaaatctggttgtccttcgccgtacaaaaatgccggcgattctggtcgaagtcggttttatcaattccgattctgacaacactcttttcgataagaacttcaatgatattgcgcaggcaattgcagatggaatcctggatacgctggaagaaaaagggctctggaaaccagaaggcgcaagaaacagttcgaccgcatcggaatccggaaggacttcttctgacgcagatacttctgattccgtttctcctgctgacgtttctgcaaaatcagatgttggtaccctgacaaattcaggctcagtccctgattctccttgtacgtcagactctgctcacatgaatccgtctgatgaaaatacagactccgaatttcctaattcttctccatctgtaacctacagtgtgcaggtcggtgcattccgaaatccggcgtatgccagacggcttcttaatgaactgaccgaaatggatttccctgcccggattgatgacagcagccagtatgaccgggttctggtcggtcagttcgatgtattgaatgatgctgccatgatggaacgaagactaaaacagagcggatatccaactgtgatcgtgagtttttctgaagaagtctgaatctttttactcgttattctcaaaaaagttttgagtataaaataatattttcatgtcttatcccggacaccaaagatattccattcaaaacgaaatttttcgagattgctttcaataacaacgggttttatacttatataccaaacacaaaaaacaaaggaggaaaatgatatgtcaccgagaaacacagcgaaagcggatattgtcctgaaaaatttctagaaagacaatgcgcatttcgcagatttgttcaatgcagtcttgtttgacggggaacaaaagctgcacccggaagatctcagggaagctgatgtagatctttcatctgtcctgaaattcaacggacatatagaaacaatccagcggctgagagatgtcgtaaaaaagacagcctatggaatggattttgtgatctggggtattgaaaaccaacagaaaatccactatgcaatgccactaagacatatgatagaggatgcactttcatacttaaaagagtataatgaaattgcaaaaaagaatctggatgaaaagaccacaaatacaaaagatgaatttctatccagattcaaaaaaacagaccggctgcatcctgtaatcactctgtgcatttattacggagaaaaggaatgggacggggcaaccagtttgaaagaaatgctggaactgccagactatcttgagaatcttgtgcccgattataagatgaacctattacagctcagaaacagcgaaaatctaaaattcaaaaataaagatgtccagacaatatttgatgtaagccggttgatttatggcaaaaattatggcaaaattacaagtatctacaaagatcaaaatcttacaaatgagttaggaattgtaattggcgcaatcaccggctcgcaggaactgataaactatgcagcgtcagaaaaagaaggaggtcaatttaatatgtgtacagctttagatgaattaatagaatccggaaaagaaaaactgcttaccgaaatggttgaaaaaaaacttgccaaaaataaaactccagacacgatagcagatgaactggaaacagatatttccataatcaataacattatcgagaaaattgaaaaaagtgcataatcagcacattatggttattttatccattacaccgtgtaattaatgaaaaatctcattttctaaaaaagatcctgtataaaaccactgcctaaacaagctttgattttagcaggatctttttatcatctcacaaaaacacacttatatttctatctcatcacttatcttggcatccccttctcctcatccgcaacatactcaaagaaatcaaagtctgcatattgtttatgtaacactctgtctgcacaggtcattcccacaaatgttcctgtaaattctccgtatttgcagtattcatctgagaatttcgttgtgtcaaatggtccaccgatcttcacatactgttctccgtcatagctccactcgaaccatgattttcttccatcaatattcaatctcagatagatcggcacatccgctaccgggattctggtattcagcagctctgtcttagttccattctccaagtggataatagaaagtgcactctgtcccagtgtctggctgtaatatttgcggagattgatgtaattcatgttgtcataatacatgatcagtccggcgctgtgctgatgggtttccggcttgaattccatcttggtcgtcactttcgcatatacgctggtcaattttcttgcaaggatgctgactttattcagagaggttctggattcctgtcctcggattctcacatacccaggacggaccttcacatctgcaaatctctgtggcatgattcttggggcataataccagtttccaagttcatctccgtcgaaatcgtcaaaatcaggaatctgcggtaccggatattccgggagcttgctttcttctacatattcttttgcaagattatcatcgtcatacatgcgaagccatccttcttctgtccatttcatcttctggatcgcagtttctcgcccgagagtacaacgaagttccggtgcaaatggtctggcacaaagatgtaccagataaacctctccaagtggcgtttccacataacttccgtgaccggatttctgtaatacgctctccggattatagtactttggtttcagatgatccggatcctgtctttcgtaggatactcccggaacacttgtcacgattggatttgtcggatctccctcgtatggtccccatacattttttgcacgtcccatggttacacaatgattatatccagttccaccttccgcacacataatataataatatccatttctcttggtcagatgtggtgcttcgatacagccgcggtcggttcctccgttccagatacgtttcggataaccgatcacttcctttttctccggtgaatattctaccatacaaatcgcacccggtttttcatagccttcacgggtttcccactccagggatacaacccattttctgccatcatcgtcatgaagcatggaggcatcaaatcctgctgaatgcagatataccggcttgctccatggtcctcgaatatcctttgctgtaatcacaaagttgtccacatcaaaatatcgcgcgttcatggaattcatcactccataaaccacatagaacagatcttcctgttcacaatatgtcagacaaggtgcccagattccttttgccgacggaagctttttaagatccacttcttcgtcatctgtcagtacgtgtgtatatagttcccagtttttcatatcttttgaatgatagaccggaattcccggcatccattcaaatgttgatactgctatataataatcgtccccttttctgcaaatacacgggtccggattgaaacctttaaaaatcggattatgaatcatgatcgttcctcctatatgatcaaatgccgggattttttgccccaacatctaaattatcattttatttttccactacactctcggaaaccagccaaaatctacacatcttccaagatcccagctgtcccaaccgatccatcctttatcattgatcgtatcggtcaatagcttataactccaataaaaatatccgcttcctgtgttccatgcttcaagctgcgcctcagccactgcctgatagattttcttcttctcttctgcacttactgcactttccacgtctccctccaaaccatttaacacagactgtccgccttttgtatcccagccacatgccagagagttaaacagacaccattctccgcagataaccgggaaatattcttccatttcctgaatatctttttggtaaacctctttaatatattttacatagccttcaactgtctgttcacaattgtccatctcggccatcatcaaatactgatgggtgtccagaactacatttttatatttttcttcctgcatgtagcccttccattcctttattgcaaatccgtcatggatgactacatacttttcttccggcatatattcgcgaatcctgtcatatgcatccttgtaaaactctttgagaaatgcaaaggttaccggtgcagatccttctgccatctcaggatcaaacgcaggatatctttcctgcatattcatactgtcccacatattttctgtaagcggttcattaattacttctattccccataagccttttctgtttccatagcgttttgccagacgttccagtacagaaagaataaattccacttcttccggatgctgtgcccatttgcatacaccacagattccgccgttatcaaatccgttctgtccaaggggtgccgtgtgcagatcgatcaaaatctgcagtccgtatgcttctgcccagttaaatgccttatccagttcttccacacatccgataaaaggttctctgtctccaaatataaagtacggaaccggaatacggactgcttccattcccatagacttgattgtcacaaaatcacgttctgtaatgtattccgcgcggtggatctttattcttgcctcatacacttcttttgacagctgtctcggcagataatattcatcttctgcagttgtccctgcaaataatgccgggctcatccatttttctaataccagccagtttccaagattgactcctttgactttcattcatcttacctctcttatccatttattcgtaaagacatctgcctgcacagatgcctttatccttcctgtttcttatttcgcctgacgcgccttcagatctgcaataatctgtgggaattctttatcaagcttccagaatttcataatcaaaagaccacatgcatagacagcgatcggaatccatacgaagcagacttcgattgaacggagtgcggatgcactctgaacagctgcatctcctacatatccgccaatctccaggatcattccaagaagtgcagaaccaataccatttccaatcttatatccaaaactgcatgcactgtttaccagtccctcagtacgataacccgtcttccattcaccataatcaatcgtatccgaaaccatagcccacatggttgcaccaccacacgcattaccgattccacgtatcacactggagaccacgattcctgccatagagccacccgcgaaattcagaagcagcattccgataatatcaagtaccagaccgattgcaaatacatttttcttaccaagacgttttaccagcattgcaatgaagaacattgcaagaatctgtactacattgaaaattccgttgatcgtagataccagatttctgtcacctaaaatatcttttgcataataaacggttgctcctccatttacagaatacattaagaaaaataatgcaagcatgcctgtcatcatgatccagtatttatttttaaataatgctttgagaccttctttaaacggaacatcttccacttttccgtcttcccctgccgatgccggttttacacgttcttttgttccaaagaaattgataaggaaagctgccaccgctaccagaccgaatacacagaatgtttttgtccatgcagaagcatcatttccgaatttttctactaacggcaaggtaaatgtgttgataatcagcgttccggctgtggccagtaagtttctgaaaatacttaataccgatctttcatatggatcctgtgtcattagcgcgttcaatgcagaatatggtacattgattgctgtatagatgacagtggataccagattatacgtaataaagacataaactaatttcggtgttgccgcccagcttgtcggtacagaaaaaagtaaaatccctgaaattgcaaatgggatacacatacgaagaagccatggtcttgctttaccgaatcttgattttgtacgatccacgatcacacccatgataatatcgctgataccatcgaaaattctcgacaccatcatgatggttccaacagccagtgcacttacttttgcatagtctgtataataaaacagtaagaaagccgacatcgccgtataaataatattgcatccaaaatccccacatccgtaggaaaatctttccaccacctttgaaaaggttaatttgctctttgattccatcgtttcattcctctttcatcatatctttttcatctgttttgttctttgcgcactgaacagccttttgtttacgctattatagtatcatatcccatctggtgtgaataggtcttatcctctgcaaaacataggtcgatattctctttttatttctctgaaaatatgttaaacttggatatagtaaaataagtattttctaaaacaaacaggaaggaagaacaaatatgtcatcaacgcattctcctcatctgcttttcagtcccaaaaagaaaagcaacaacaacgaaaacaatcattccttctcttatgaagtcatctctactttagaatcaacgggtgtccattttcgaacctctattgatcccggaagctatgttccggctcatttacatcatgcaatagagatcatttatctattagaaggaaatctgactgtcatcatggaatcttctgttcgtgagtatcatgccggggagtgtatcctgatcaattcggatattattcattctacaaagtgtacctctccgaacaaagcaattctctttcagataccactctcctttctttctctgtatctcccggatgccgaccagctggtattcaatctggaaaacccggaagaaagtgctgtccgccgtacaaaactcgatatcttcaaagagacgctggttcagatgcagattgcaaatgatatccgtccggaaggctttatcttgcgtttcaacagtctgctctttgaaattcttttccagctatatcataatttcagtatccgtgttgttcatggaaatcagacacagagagataaagaccgcgcaagacttgacacgatcttaaactacatccgtcaaaactataaacaacatatcagtattgaggaaattgcaaatgttgcctatttgcaatccggctatttttgccgtttctttaaaaaatgtatgggaattacctttctggaatatcagaacgaattaagactttcttatatttaccaggatattctttcgactgatgattccatcaaagatattttggagcgccatggatttacaaattataaattattccgccgaatgttctttgaacatttcgagatgacacctaccgaggtcaggaaaaacagaaatgctacttaatcaaaacaaaaagaacagaaaagattctcagataccaaaatcttttctgttcttttttgtatattataaaggatagattagtacctcctcagaggtcatgtgttccccttgataaaagggctcagttcattaagggcgaatgctctttgccagttctttcgcttcttttgtcagattacagattttctcgaattcgccgtttttgatcagatctgcttttaccatccagcttccgccgcagcagatgatcttgtcaaatcccagataatctttcagattctgtgttccgattccacctgtcggcataaaacgaagctgattgtatggtgctgccattgctttgatcatagccactccacctgcaggttctgccggaaagaatttaactactttcagtcctctttttactgcctgtgccacttcagacggtgtcacacatcccgggaaaatcggaatttctttttccagacagtaatttacgatttcaggatcgaatccaggacttacgatgaattttgctcctgccttaacagcagcatttctcataaaatccgttttccttgagttcctctaagttttctccaagcctgtaaacgaatctgtctatcagttccttgatagaaaacgcgctgaaggaaaaccataccttgtttacatgaccgctggtaccaataaattcttacgaatctactatggcaaggttaaggagtgcttacgcaacttagagcaatctcaaatcgaagagtcttaaatatcaaacgattatcacctccgttaagctagccgttttgggtagcctatttcttgtgcctatttttcaactcttaaatttcttcaaaaagtacttgactttttattagtaggctttcctgccgaaaatataagaaccacagggaagacacagtaagccttgtttgtgtcatttctcggggcgaaaatcggggtaaatatccctttctaagcctttcaaaaaagcacataagttatttgtactaacctgtggttatgtattgaattatgggttttgggtaacaaaaaacaccgtatttctacggtgcgttctgtcagatatattctgttttatgatagcagaaaactggaattcacagttcttccatccttcccatcttcagcgccataacaagagttccggctgccatcataaagacaccaatttcaatcacatagatgggaagaagcgccggacctgccacggcaaagaagtccacgataaaatgaatcccatatgcaagaaccgctgtaatagccgctgtcctgcatttgcctgcctttaccgcccggtagatcagcagtgacaacccgatatgcagaatgatggcactgattctttcgattccgcttacaaaaaagagtggtgccggtgttgtccatagggccgacagctgtgacacggtctggtttgcagactcagcaggaagtgccgccagcgtattctgcatggctccgctgttgatcatcagcatggacacaagattgctgattccggagagtcctccgatcagaatggcctccacaccgccatgcccgattccatacatcagtgcatttggaaaatccagccatttcttcatccagaacttcatggcaatcagtcttccggtctcttcaaaaaccgctgcagccaaagccgcgtacacatagtaaagccatggcctgctctgtgcgttcagtccgcagaactgaatgacaagaacatgcagctgctgctccaacagcatggcaaacagcagataggttcctgctccgataaagaacgaggaaatccttgccttaagcttcacccttcctgcaatgaacaaagcaatcggtacccccatcgagaggacaacggagcagataactcccgctatcgccagacctgatattgtgttcaattccatctttatacctccctgattctcaaaaaattcctttattgtatttgaactgtccatacaatataaagcctaatccgacaataactgctggaagaatgatataatctataattatttcactccaaaacgaaacaataaaacctaatacaagagatattcctataatcagcgttcctgtgccgactgtttttccatactttggtatatcttcttcctttacttttcgcctgttataagagtgaattgtgctgatattgcctttgatatttacaattcccaaaacagatatgaacactcccaaaatcaacattataatattttccataatgacctcctaaaaatagaatagttcctcaaattttttgtccaatgcaatacaaagaatcagagccaattttgcagttggattaaactgtcctgtttcaatagaactaatggtatttcttgatacccctaccatttctgcaagctgagcttgagaaagatttgcttctgtgcgaacttcctttaagtgatttttcagttgtaattgttctttcatattctcacctctaaaagatggctaacaaatccaacaaatgccaaaatggaaagcacaaaaaacagaacagtcaagaccaaatcgctctttcgcttcattttgataaaacgaactaaccattgtgttgcaataatgctgaagtatataacccacggactgtaaatcatagtatgagcaagcacagaagataacagcgaaagcaaacaacacactaaagcaccaactctgcttgcgtgacttccggcttgatataccacttccatttcagccaagtccttattgcgatgttcttttctgcttgcatttaagatttcgtcctttttcataaaaacacctccataccaagttttctttgcatattttaattatacacataccaagttttcttgtcaatagagttcataaaaaagttacaaccgatataagagataacttttctaccacttcgattatactcacgacttaatgacttcttgaatacttgccgaaaaagaaaaactgccatcggtttgacagcagttcttcttcggttagtatcagttaggaatacataatatcattcaatacaatctcatcggcacaggctcgaatgttattcatcaatcctatccatctcatcatatccgttgcttttctgcacgcccaggttacaatctccggttcgatcatcagacgtacatcaaacagatccagtgccaaccgataacggtcctccacgtttccaaacccgagaacatcattttccatataaatggtactgatgacataagttccgtctcctctgcgcacttccagcacgcctcttgtgaccagccctttaaccgcctctcttaccgtacttcgtccaacttcaaataattctgtcagttcaccttcagtaggtatcctctctcctatttttaccggtttatccagaatatatttcatcagtcgatcctctgtcttctgtcccagtgtccgttttacaccttttccgctttgctgcatttcgtcaccttctgcttatccgctttctcaaattttagcatttgttttttctcttttcagctctgcattgcctgcccttctcatttttgctatactgtcaatgtagttttgcgccatagtttccggcgtatcgttattttgactcaggaggaaatttatgatcaaattagttgcaagtgatctggacggcactctgcttcacaactatcagcagactgtgccgaaagaaatatatgatacgattaaagcacttcatgaaaaaggaatcatcttcactgccgcaagcggacgccagtatgccaatatccgcaggcttttcgctcctctcggcttcgacattccatatatcgctgaaaatggttccatgtgcgtctataaagaagagatactcgccaccggtctgactccatccaaaaccatccggcatattttggatgccctgatggaataccggaagatctatcacaccggacactgtatcctttctgtaaaagatacttattacagcgactcaaccgatgaacgtttcattgattatatggaaaatgatatgcataacatcgttacctacgtgccggatctgtatgcgattaaagaaccgatcatcaaagcagccatctgtgattttggtggcacaaagaatctggaacccttcttccacaaaaggattggggatgaaatccgcgttgtaacttctgcggatcactggattgattttattgcgccaaatgcaaataaaggaacggcactgaaagttctaatggaaaaattcgggatcaaaaaagaggaatgcatctgcttcggagaccaacagaatgatatcgagatgctgaaagctgcgggaacagcgtatgtcatggcaaccggccaccctctcgccaagaaagcggcagattacgttgtggaatcacctttgccggtgatgcaggggttgttgtagagtgaaaatgggaacgctccatataaagaattggactgataactgtttcagaatataagaagctctaagaccacaaaaatttattaaaagcattctggaaaatccataactcgcttcgctcaaacagatggatttttcagaataacataaatttctgtaatctaagagcttctaatattcttccaaatgttaccagtccaattctttatatggagctgttttttcaagacaggcaactcctgaatgatggaggggcggtgactccagaacataatggagaaagtgcgcctgtaacccgaggagcgctggacggctgcgagagcagcctgcagctaaataattttctgaaacgaacagcgcagctgaatgtttccgtcttgacggcatttgagacttttagggaatcttaggttttgagaagatgcgttaggggaagaaatccacactgtctgagcgacagcgagtttgtggatttcttcccctgttttttagcatcttttcaaaattttagagtcccttaatgcctcaagcctgtccggcaagatggaaacattcagctgcgcgtcccttttgaaccagcaagcctatataactccccctatgcgttctcccatcttcacaatggtttctgctccttgcaacgtgttccggatcagatcactgtctggcaagactttatctggctccaggagcagcacaaccgttgaacctccgaattcaaatcttcctttttcttcgccgcgttttacctggcagcgttcttttttataattccggatctttccgaccatcagtgcaccgacttccatcatcaggacggtgccgagtttttcattttttacaagacagtattctctgctgttcattttgtagatcgggcagatatcatttgcaatcggatttacagtatgaaaaattcccggaatccttctctgataggtcttttctccatccgccacgtagcaatatctgtggtaatcgtctactgtaagacggattactaccgcccagcctcccatataatgtctggcaagctttgcatcgcgaatgaggctgtgggttgtatatggtgtatgcttaatgaagaatcgtccgttttcgtgaattggatagacactcactttcccgtcacatggactgatcagtacggtatcttccttgttaaccgggcgttcctcagcttttatttttctggtaaagaaatcattataggaatcaaatttctgtttttcatatttattcagatcgatcccatgagttctggcaaatagtccggcaaaaacagcggatacttttgtattcaacagcttcccacccaatctggatactgctggtaaaagaaatgggcgcatcagtaccctggttgctgtatgggtatacacaaattttaaaaacttatcctgactggttgtcttttttgtccgatgaccttctctgtccatgtaatacatttttctatctcctgtccgccttatccatgcctgataatatagctgtcaggcagatctctgcccttcactttgctgcctgctcataacctggtttcattacatcatgctcatataacgcatatagtgccgaaccagaatagcgatcactgccattgccacaacagctacaatcgcacccatggtcacatttttcggctttttcagtttgaaattggtgataaacagaatgccgaccaccagcatgaccacatgaagcgcaagcataaattcacaacctaaaaatggttttaatacaaccacaagcggaagtgcgattgccatggatgtgatcgggagcccctgataacattctcttttctctgttgtttcttcctgacgctgttcttccatcacattgaaccacgcaagacggatcagacctgcaagtacataaaacatcaggattgccacaccgatcacaccgcgcattccgaaacagtaacaaagaacagccggcgcaactccgaagcaaacaatatcgcttaacgaatcaatctggattccgaaacgcttttccacttctgtccggttcttttttgttcttgcaatctttccatcaaacatatcacaaaggccggagattgcaagacacatcacgcccagatgcagatgcccgtttactgcaaacatcattcctccaattgataccatcaaactgacatatgtaagtactaccgtataatcataaacccctaacattctatctccctctttcttccaattgtaaaatttgctacgatcgtaagcaaggcgctcagccccagctctgtataatatccaatcccacggctcaggatcattcccggcaaaagaagccgttttccgaataccggaataaaaatcatggcaaataatttttcactgattcccatacctcccggcagaggaagcatatctaccgataccgcaataactgcctgcagtgtaatgaccacaattgcctttgcaccactaagtccaaacgccttataaacaaaccacgttgctgtaaacagcgcaaacctctggaacatagtaatcgcaaatacattcacgatcacctgcttgtgttccttcagaaaaactgctgtatcccggtactgatccatggatgcattcagcttttcaatacgcgcctccttatggtgtagaaagtgcagcttttcaagcagtgccattccttttaccagaatttctcttgcaagccgcggatggaacaccagcaccagcatcgctgtcacgcagaaaacattcagagctgtccccagataaaagatatgccggatactccagagatatttatggataaatccttgtccgaacagtaccagccacaatccgacaaccaccagtaccagtttataagtgatcgtaacgatcatcagcaccagcgtcgaaaccggtattggtatcttttcttttttcatataataaatctgtgccggctgtcctccagatgccgaaggtgtgatacagctgaagaagaatccaaccgatgaaaacagaaaacatgtccattttttcagccggattttcagtgtccgcatcatataatagataatgatcgattctccccagataaaaaccacaacacagatcactcccggaatcagccataatacattgacctgttccaggatcttcacaatctcaccaatatcttccccatgaaatacgccatacattgtaccggtaaataccaccagcaaaaatatgacattgaagatcgtcttctttttattttccatctctcctcattcctatccggtttccaagtttatttgctattttttctgtcagacgccgataaatctgccatccatttgtccgtctgctgatctgccatgttacttctgcaagaagaattcctgctgctgcatcctgccatacatgctgcctaagcgccagtgtcgatatcacgaccagtaccgtcatcaggacagaaaaagctttataccagttggaaatcttccggttcttcctgaccgcaatacagctgaaccagcttgccatgcagtgaatggacggaaacaggttgattggcttatcaactgtatacaaaaaccgtactgcctgcgtccagatatccgtccctgtcagaaccggcctcgtattcgtggtcggataaaaaataaagcacagcatacataccagccgcgcataaaaatccgcagtaaaaaactggtatttcaccttctcctcccgcatcgatgccatgaaatagttcactacccagaaaagataacacccaaaataaataataataaactgtggcataaaaggaatcacttcatccgccggaccagaaagattatgagtcttgattcccgtccgtaatagcggcactccccaatataccacagcattcatacaaaatgtaataataagtggaattatagtttttattttcttcatacaatctatactatacataaataaaaaaatagcaatagtctttcgcaattcttaaagaaaaaagttctgtctcttaagaaaacagaacttttttcttttatatttctttatttttacagaacctttgacaggaattcctttaaacgctcatccttaggatttgcaaagaactcttccggagttccctgctcttttactcttccttcatccacaaacatgacacggtcagcaacctctcttgcaaatcccatttcatgtgtaacaacaaccatggtcatgccttcctgggcaagctgtttcatcagctccagaacctctccaaccatctccgggtccagtgcggatgtcggctcatcaaagagcattacatccgggttcatggcaagggaacgcacgatcgcgatccgctgcttctgtccaccggaaagctgtgacggataagaatctgccttctcttccagtccaaccctcttaagaagtactcttgcttctttttctgcctctgctttatcctttttcaggagcttgatcggagccagtgtgatattttcaagaatcgtcttatgtgggaaaagattaaagtgttggaacaccattcccatcttctgacgatgtttgtcgatatctacctttgcatctgtaatgtccacaccttcaaaataaatatgacctccggtcggcacctccagaaggttcagggaacggaggaatgtagattttccggatcctgacggtccgatgattaccacaacttctcctttgtggatctcttctgtaattccattcagtgcatgaaaatcgccaaatgctttctgcagattttctacacggatcaatacatctccattagtggtcactgttccttagcctcctttccagcatacttaccagtttactgaagatcataaccataaccaggtaaatgatcgcaactgccatcagcggcataagcgcatcgtaggttctgcttcggatgatatctccgccctttgtcagatcctgaagggcaatatatccggcaacagaagtctcttttaagagaacgataaattcgtttccaagtgccggaaggacatttttaaacgcctgcggcatgataatatagatcattgtctgacgataattaaatccaaggcttcgtcctgcctcaaactgtccgttatcaactgccataataccggaacggaaaatctcagcaacataagcactggagttcataccaaatgccagaatcgctacgatcgtcttactgacatccacacttgcaaaaattacaaagtaaatgataagcagctgtacaacaaccggtgtaccacggatgaccgtgatgtaaatctggcagatcagattcaggagcttcagcttgccggtcttatcgtatgtggaacggacaattgccagaaggaatccgagaactacaccgatcaggacagcacaaaaggttacaattaatgtaaccttaagtccgtctgcaatgtagtgccatctgtcatcttttataaaattcattataaatcttgctttaaaatcactcataagacaccaccagtctgtacccgattagtctgtaatatattttgcaacgattttatcaaatgttccatcttcttttaactctttgatcgcatcattgactttcttaaccagatcatcattaccttttttgattgccagtgcataatcttcttctacataagaagtctccaggatcttcagaccttcattttcttctacgaatgtcttagccggctggttatcaatgatcactgcatcgatcttgccctgctgcagagcctgtacagcttccatacctttgttgaaacgctctacattatcatcaccgaaatcatctgtagaataaatatcccctgttgttccctgctgaacaccaatcttctttcctttcagatcatccggttctgtaatatcactgtcatctgttacaatgataacctgaactcctgtataatagctatcagaaaaatcaacctgtgtagcacggtcttctgttacagtcatacctgctgctccgatatctgcttttccgctctgaacagccgggataatagagtcaaatgccatatcttcgatcttcagatccattccaagcttgtcagcgattgctgctgcgaattctgcatcgattccgacaacttcatctccgtcatagtattcaaatggtgggaattctgcgtttgtagccataacaagcttttctttcttgtctgattttgcagagtcactctttgatgaatcactctttgatccacatgctgcaaaactgaacacacatgcacatgcaagtacaacactgattacttttttcattttcataataccaacctccaaattttatccatttcccctattctatcatgttgtaaagaaaaaacaaagtgggtttttatacatttttctgcataaattcccaccttttttcgtgattattctcttttagccgaaaatcaggaaataaagaagtaccagaactccaagtacaatacggtaatagccgaatgccttaaagtcatgcttcttgatatatcccatcaaaaacttgatcgcaaatacggatacgaagaacgctaccaggcatcccacaagcaaaatgaccacttcgatcgcggtataatggaatccgaatttgataacctttaagatacttgctccgaacataaccgggatcgcaaggtagaaggtaaattctgttgccacatagcgggaagttccgatgagcagtgctccaaggatggttgctcctgaacgtgaagtacccgggatcagtgccaggacctggaaacctccgatgatcagtgccatctgataggtaagctctgtcagctttgtaacctgcggtctggtgtgttcattctttttctcgatcagaatgaagaagataccataaatgatcagcatcagtgcaacaactacataattgtaaagatacttgtcaaggatatcatcaaataacagcccgatcacagctgccggcagacaagccacaacgattttgcaccacaggttgattgtatttctcttctgcttcgctgattttctctttgaaaacggattcagcttattgaaatacagaacaacgaccgccataattgcaccgagctggatcacaacacggaacatactgttgaattcatgacttgtactcatatgtaagaactgctctaccagaatcatatgccctgtactactgattggaagccattctgtgataccttccacgatacccagaatgacagcaattaaaacatctaacattttgacctctttctatcccctctcgggattcaatacaaatttttcaatggcagccgccacgccatcctcctcattggacaatgtgatataatctgccacctcttttacttcatctgctccgtttgccatcgcaacaccaaatccgacttcttttaacatcatcaggtcattgttgccatccccgcatgccatgatctcttctcgttcaattccaagaagcctgccaagctgaatcagtcccattcctttgttaactcccggtgcattgatctccagattcgttctcatcgaatcactgatgcttaaatccccaagctccatgatccgctgctttgcttccagccgttcgtcctggctcttaaaaagtgcatggatcttatccatctcatgcccattcatctcttccatcttctcccagagactcgtaatgcctttgcgggtggttcggatataatctgccatcgcaggattccgcagatactctccgactttcaaaagttcatctgcctgtacgaaacctcttccatcaaaatagatctccttgaacgtatcataatctccaaaaatcttaaggatcgctgctcccatctcataagagagcatattggcataaagtactttgtcttcctgtaaatccaggatccttccgccgttcgatgtcagtgcgtaccgcatccccgggaaattccggagcacttccgggatccctgtcaccggacgccctgttgcaaccagtactgttaccccctggtcgatcgcacgtgtaagtatttctcttgtatgactggtcagttctttcttatcattcagtaaagtaccatccagatcaagccctatcatttttatctttttcatgaataattccctcatttatggtaaagctaaaaatacatttcaaatcttagtataacacgattccccgtgtatgtataacaaaatttgcggattcaggcattttgtagtatactgataaaggctcaattttgaagaaaggaagaattatgaagaaaaggttaaaagcattttcaaggacaaccatcgcactccttaccgctgccctggtctgttccccgtttacaaaagcttacgccgatgacactgtagactctctcgaaaagcagacaaacggtcttcagaaccagctcgactctctgaatcaggaccttactagtctcagcgctgagatcacagatcttgcatcaaaaattgaggatacggatgcttccgtacagaaagcagaactggatcttgccgccgcaaaactggacgagcagttacagtatgatgctatgaagaaaagaatcaaatatatgtacgaaacaggaaatacgtcactcttgcagatcatcttttcttctgaaagcatgggagatttcttaaacaaagcagaatttgtcaagaacattacagaatacgacagaaatatgctggatgaattacagaaggttcacgagcttgtcgctaaaaaggactctgatctgaaagcagagcaggcttctctggcagagatgaaaacaaatctcgaccaacaggaacaggaactgaatgacaagatttcctctacttccggtgaacttcaggcttcatccgaagcactggcaaaagcaaaagaagcacaggcagccgctgctgccgcacttaagaaaaaacaggaagaagaagctgcagaacaacaacgccaggcagaaactgcacagactgctgccaataatacttcaagcagctccgggaacacggattccggtagttccggcggcaatacgacgattacagttccggatactcctgccgagaccacagatctggttctctttgctgcaattctgcagtgtgaagccggcggttacaattatgacggtattcttgccgttgctacagtcatcatgaaccgtgtagcgagtccgctgtatccgaatacaatcagcggtgtcgtctaccagagcggtcagtttgctccaacctgggacggaagcctaagccgcgtcttgcaaagaggacctgtatccttatgctatcaggtcgctcaggaagcactcggcggagcacggcttgcatccgtaagcggatgttaccagttccgaagcgcaagtaccggaatgtccgggatcaacgttgggggaaatgtatttttctaaatcctgtcccagtggatgtgcgttcgattcattcacaggacagaatgcaaaaaaacggtatttactcatcttcacgagtaaataccgttttttattttctacgcattatagtttgcaagaaactgtgctatcaattccacacaaccttccacatctttttcatctgctacctctgcaggcatgtgcatataacgaagcgggattgataccaataccatcggtacgccctgatttgaaaaatgaatcttatctccatccgtataactaagcctgcttgcagcttctctctgaactggaattcctactttttttgcacattcttccattttggcatttaaagtttttaccacgatcggactgttgcaaagaaccggtccaccccccagaagaaccgttcccatctcagccggattcattccactgcagtcgcttgtgtaagtcacatccacaacaatcgcaagtgtcggattaatccgtgtacttgtccagaaagctccggttttcgttgtctcctctccagttgtagaagctccatagacaccaactttacatccaagctctttcgctctcttgattgcttccataatgatataaacaccaagtctgtcatccaatgctctggctgtaaatttaccatttgtcatcttacgaatatgtgtatccggaacaatcggatctcccagacttacattctttaaagcatcttctctatctttcgccccaatatcgatcagaaaatgctttgttcccagattttcttctttgaacaaatcacgatatgcttcgacaacaccgtaaacctctccgttttttgtcttgatacgcacctgacgtcccggataagttgccggaacaattccgcctctgtcaatcacctgcagtcttccatcttcccggatgttcgaaatcataagtccgatttcatctgcatgtgccgaaagcatgatacgtacatcgttttccggattcagaatacatgttagattttgcatctcatcacggcaaatctcatctgtatattctttcatttcttctgttacaatatcctgcacctgctcctcataacccgataccgaaatactgttaagaaggttatttaaaaatttttcattcattctagtcatcttctttcttacttagccgtaactttcagaagatctgcaaatgcagacagattataggttccaagtccgcttgcaactgcatccccgatagcagcacaatccattccccctgcgattgctgcctgcagtcctgcttttgcgtcttctacaaccaaacacttatcaacctgttcgtctacatactctgctgctttcacaaatacttccggatccggctttgattttgaaatattatttccgtctgaaattgcatcgaaatactctccaagtcccaactgcccgagaataaatcttgcgtttttactggatgatccaatcgccagtttatatccattcgcacgaagatcatccaatgtttcctttacttctgcagacagatctgcaggactcatatttttcagaagttctttatagatatcatttttctttgttgtccagcattctttctcttcttcgctcatttctccttcatagcgttccagaataatttcaaaactttccatacggctcacccctctgagtcgattattgatttcttcatcaaaatagattcccagttcatctgcaactgctttccatgcttgataatgatatttatctgtatgacagattaccccatccaaatcaaaaattactgcattgtatttcttcatcttttgcttctccttctgtttcagacaagttagaaatgatgacagcggctaggatgatcgcacatccgatcaccatgcgaagtgtaatcacttcatgcagaatgatgatagaaaaaatcgttccaaatacagattccattgaaagtacaatcgctgcttttgtctcatctacatacttctggcatgcggtctggagcagataacatacagtcgtactgattactcccagatacaaaacacttaaccatccctgtgttgtaacctgaaaatcgttctctccaaaaatcacaagactgactgccgataatacaaatgctgtgatcatctgcaccatgttcagtacagatgccggatattttttcacaaattctccggtaaaaaagatttggaacgcaaatcctaccgcacagagaagtgtaagaccatctcccagactcagtgtaagatttccattcaaagaaagcagtgctactccaataacggacatgattgctccaatgattcctttcatgcctactttcttcttcaaaattataaatgcaatgaacggcactataactacattcagtgctgtaaggaatgcatttttggaaggtgttgtatattgcagaccgataatctgaagtgcaaatcctgcaaaaagtgcaattcccatcagaatacctgcttttattgcacctgcacgcttctcaagtttcccttcttttttatgctgtcccatgctgatcatccccatcagcacagatgccaacaaaaatcttaccatcataatctggaaaggcttcatgcttcccagtgccatatcacttgcgacaaagccgcctccccatatgaccgtaaccagtataagtcctccgattgccagccattttttcatcatatatcctcccgtctcttttttagattgttgttacttttccatttatttcagcttctacaggttctcctgcaagacgaatgacctttgcctgattacttccatctgccgtaatttcaagccatgcccctctataatgcagacggaatgttaatccctgccattcctttggcatattcggatgaactttcaacataccatcttctctttgcgctacacctgcaaacccaaatacaattgtctgccatactccaccagtatttgccgcatggattccttctcttgtatttccctgcatattcaacaggtcaataaaggctgcgcggcgaagataccgatatgcttttgaatcatcccctactttaagccccataacagagaaaatactcggactcaatgaagaaccatgaagtgtacgcttttcgtaataagcgtagttttctttaatcgtttcttcatcaaattcatttcccataaggtgtaacagcataacaacatctgcctgcttattgatctgtgtctctcttgctctttttgtcttaagtgcatccggacgtactggccagtcattctcatcatatttttcgattgttacattatcaagctcgaaatatccttcaaactgttccagaagtcttgtgccttcttttcttggcagatacatcttttcctgcacttctttccagtgtgcagtttccgcctctgtaagtcctgtcttttcgatcaggatatcatacgcttcctgattctctttcttgattgatgcaagcagtgaaagaacatatccgagattccatctcgccagataattggtatagaggttattattaaccggttcatgccattcatccggtcccgttacctgattgatttcataacgatcctgctctttgttgtactcacaacggcttgcccaaaatcttgctgtctctgtcagaatctccgctcctttgctgtaaaggaaatccatatcctgcgtgatcttaacataattatagattccataagcaactgctgctgttacatgatgctcatataccgcaacataacatctataacaggttccatccggctcaatggtccagtccggacactgctctgtaccatcatctgctgactcccacggatactgtgctcctttatatccattcttatgtgcatttgcacgcgctgcatccagaagatggtatctgtaattttccagattctgtgcagtcttcggaaatacccatgagaaaaacggaagcataaaaagttcggtatcccagaaagcatgtccaccatattcttctcctgttaaaagctttgccccaacattcacatggtcatcatgttcgtttcccgtactcatcagatggaagatgttaaaacggactgcacggttcaattcatcatcccctgtaatctgaatatctgcattttcccacatcttcttataaacatcttcatgcgctttcagttcctgatcaaatcccgtttcaacaaatccttcaatttctttttcgattgttgtatgaagagcataagccggacattctctttctgtatacatcgaaacatattttacgatttctacttcttttccttcttctacatggatatcaccaaattccacactctgctcaccaaatctgcttatcattctgtttccaagaatctgttttccatctgcataagcttcgatacggcatccacaacctacatgcagatgattttctctggttgcaacttccacataacatccatctgctgccagcttttcattcgctgtcatataagtatgttttaccttaaagcgtggtgcatcataaaaattaatgatcgtaccatcaataatactttctacttcaataattccactgtagttgagcggtgtcacataaagccggattcccatcctgtgtacattgtttctgctcacaaaccggattccttcgatcaaagtctctcttccttttgagtccttcagacgaactctctttccaagaaaagctcctttcatatcaagcactcttgaaaattccaaaatttcacagtcttcaattccaatcaattctttttctacataaagtctgattccaagccagttcggaagtgtggaaagttcacgcataaatgtctctgacttgtcaaacactccattgatataaagatatggaagtgtaatctttgttccttcctcatgacttccccggattccgaggtagccattggaaagtgcaaacaaactctcatatttgagattctcttttgcctcatactgatcctgccagatgagccattcatcgctatgtaatctgtttctcagatttcctgaaaacatttctctgctcatatatgattgtctcctttattcttaatcgatatactgttttcttgccttccggatttcggttccgcattctgctgcctgcacagtaaatgccattgcaaaatcctgaagttttactttattttcttccaactgttcttctccacagctgttgcttccaagtcctgactggcgataatccagatggataatcacatcatccgctttttcaatttcaaatggatgctgtgctttttccagactttcatcggtataattagcaaggttcagaccaagcttctcctccatcttgcataacagaccatcttttccatctccaatacggaaccatttcacctgttcatgatgtccgttttcctgtgggaatacataatctgtcatcattccgtcaactgtattttcgtaaattcccataatagatgcagccttactgtctacataactctcaccaggtcccataccataccacatcgtcttctgaaagtttttatttcctttcataatgactccgatacgtggtaagaacgctggttccagttttcctctctgaacagcttttccctgaatttccaccttcatctgtccacaagaataaaccgtataagtgtaatcacattcaaatccccaggactggttatagcaactgaagaatgttccgatccggacgatcaccttatcgtcttctttcagacagctgacatattctgtctcttctaccggtttctgaataaaatatttattcatccagtcctctttcttgtacatgtcgttatcgattgttgcacggtatacattcattctcggtccttcagtcagatactcttttccatcttttccaaaagaaatcaattttccaaatacagtactgaattttgctgtcacacggctgttttctacagtaagccccccctgttcttctgttacctgaagcttatcagctgtttctcttaccgaaaatccatcttttcggatctgcatcggaatctggactttcttgatttcataccctgctggtgcatagtttctttcttctttctgacatacagtcagattcagataatagtctgtattttcctgtaattcaaatgctgtaattggtagggcaatgatcttgccttcatgcggagcaaccgaaagtccttcaacggttccgtcctgtatcatctgatcttccgcttttacttcccaataaagtgttgtcgtatccagattcaggaaatcataataattccggatctgaatcttgttcatgcttccttcaacagctgtaatttctactggtgcaatgatctgtttgtattcttccattcccggagacggtgttctgtccggcatcagaatcccatcgatgcagaagttcccgtttgttggaaaatctccataatttccaccatatttataatatttcttatccttttcttcagtgtaaattccatgatcataccactcccagagaaatccaccctgaagacgtttgtacttgcgatacatatcctggtatgcttttaatcctccaggaccatttcccatcgcatgtccatattcacacattacgtgtggcttatcccctttgatctgatattctgcaatctctttgagacctttcagtctggtatacatcgtagaatatacgtctgtcacttctgcctcaaaatctccctcgtaatgaaccagtctggtatcatccaactcacggattgcttctgctgcactacggaaattgcatccgaatgcggattcatttcccatagaccacataataatcgatggatgatttctatctctctttaccatacggacactacgatctacgtaagcatctttccaggtctcatcatctgtgatccatgtgtaattttctacccattcaaatccatggcattccaggtctgcttcatcgatcacataaagtccatattcgtcacacagatcataaaaatattcatttgccggataatgcgagcaacgaacagcattgatattgtactgtttcatcagacgaatatctgattccatctgctctcttgtcactcttcttccttctcttggattataatcatgatgattgactccgttcagaaggattacctgattattgacacggaagttcttatctttgatctcgattttgcggaatccacatctgactgttacttcctggttttctgtcattactgtaaattcatataactcaggtgtctcggctgtccatgtatgaacttccgggatctcagcctcaatacatatatcttttccttccgaaacaagctcaccttcaagaacagtctttcctttataagaaagcttccagccaagatttgtaccagcctgtttcattgtaattccagctgtaaaaaaaccatttttgtagctgtcatccaatgtcccatttacacgaagatccagaactgcattcttttcctcattgatcagttctacatccctgtagattcctgataaccaccacatatcctgatcttccagataagtaccgtctgaccacttgtatacacgaacggtaatgtcattttcacctgtttttacaaacccggtaatgtcaaattctgaaggcagtctgctgacttttccaaatccaacatggtttccatttacccatacatcaaatgcactgtcaacaccatggaatttcagaaccgtgtctttttccatccactgttcatctaatacaactgtctttttataaattccagttggattttcatctggtacatgcggtgggtttaccggaaatggatataacacatctgtgtaatgcatcttgtcataccctctaagctgccatacggacggaacatcaatcttatcccatccttcacatgcccccgactgttcaaatccttccggcgataattccggtgcatcaacatatttaaaagcccattctccatttaaactgattttcttttgcgaatctttataaaaagccgttcgtgcttctcttctcccaattccggtaatccgatggtcttcccatctttttactttttttcttgccataattttctcctctcaagtggtatcccatataagacagcaacagcggtcagacagatacagtctgcctgaccgctccatacgcctgtctatttgatagaaccactggttccttcaacaatatatttctgcgcgataatgaaaataatgatcggcggaataatcataataatcgtaatacaaagcatcggaataatctgtgtactgtgaactcctttaaatgaagcaagtccaagtgccaatgtatatttgcttctgtcctgtaagaaaatgagtggtccaagatagtcattccatacagtcagcatattaagtacaccgacaagaatcaatgaaggtttcatgatcggcatgaaaatcttccagtaaatctggaactgatttgcgccgtcaattcgtgctgcttcctcaaaatccttcgggattcccataaggaactgtctcatcaggaatacataataggcagatccgaaccatgccggcacgatcagcggcttcagtgtattgatccatccgaataagttgaattccatgtactgcggaatcatggtaacatcccatggaatcatcattgttgaaagcaggatcataaagaggatattttttcctttaaagttaaatcttgcaaatccataagcaaccagtgaacatgaaagaacctgtccgactgttgtcagaactgttacaagaattgaattccaaagatatgttccaaacggctgtgatttccatgcattaataaagttctcaaaatgccattctgccggcagaagtttcggcggatatgcaattgcttctccttctgtcttaaatgcagaaaacagcatgtaaataaacggtgcaagaaagtaaatggctaccagtccgagtaatatgtaaattacaatttttgattttttagacatcttcattactttctacccccttttttcttttttgttttctttgctccgctgtttttagcttctgtctcatagaatacccatgcggatgatgacttgaataccacggcagtcagcagcagaatgatgataaacattacccatgcgtttgcactggcatatccaagtttgtgatgtttgaatgcgttattgtatgtatacagtccatagaagtaggtagatttaagcggtccacctccggtaagaagcataaccaatgttacctgttggaaagaactgataattgacgtaatcaggttaaataaaattgtaggtgtaataatcggaagcgtaatactgaaaaattttcttgcaggacctgctccatcaatagatgcagcttcgtatacatcaaccggaatatttttgatatctgtgtagaagataagcatcatcgttccaacaccaaacgcacttgcaattataactgcaaggagtgcccatgccggatcaaccagccacttcggtcctttgattcccagaagagataacagataattcagtacgccataatctccgttgaggatccatccccagatgatagaaaccgctacacctgagataactgccggaatatagaaaattgtacggaatacttttactcctttaaccggctgtgtgatcagcattgcaaggaacaatgcaataatcatgttaagcggtacgaaaattgccgcatatttcaaactgattataagggatttccagaactgtttgtcctttgtaaacatatcaatatagtttccaagtcccctgaatgttggcgctgtagtaagcggccactcaaaaaagctcatgatcaaagacagaatcaggggaccgattgtaaatacaaggaacccgataatccacggcataataaacaaatacggtgtggccgtcttcaggaattttctctgcttcatttttcttctctcctatttatcggcgccggaatcataaattgttccggcgccggtttgtttgtatgctattactgtgcgtctgctgcttcttttaaaacatcttttacatccatgtatgagcttggattgaaaatctgttcaaatgataagctgaggttttctgaaatttctgaccagtcttcaatcaggaagcttgccggagtatgtccatcactctgctcaagcatctcatagaatggtgcatattctggttcatccatgataccttcagattctacaacactgttaagtaccggaagttccataccgattcttgctttgttgcattcttcgcctgtccagtattttacaaattcccatgcagcatctttattcttgctgtcctttgaaatagaaagtcctgaagagctcagaatacttacagaggtctttccgtcaaaagaaggaatttttgccacaccataattcattccatcctcattaagagaagcaattgaccatgatccatatacatacattgctactgtaccggcacggaattcatcagttccgttcttttctgttgcaattgcatatccgtctttttccatatcctggaacattttaaatacttcctgagattcttttgaatcaatttgacctgccatctgtccgtcttcgtcacaatatgcagttccattgctccacagatacatttcaaaatcatacggatctggtttcatctggaatgcaaaacctttctgacctgtcttttcttcaattgtcttggcagctgcctgaagatccgaccatgtccagtcatctgtaggttcttctacaccagcctgtgcaaaaagatctttgttatagaaaagtgaatgtgttgtaaatcccactggaataccatatgttgttccgtctaatgagttgtaattccacagtgtgctgtagaaatcattcttatagtcatcgccttctttgtcgatatactcatccagaggttcaagaccatctgcatatgccgggtagttccacatatacataacatccggtgtatctccagatcccatacctgcactgatctttgtatcaaaatcacttccgtatgcttccagtgttacttcaatgtcatcatgttcctcattaaatttatctacaagtttctgctgagcatctacatcatcagctacatcccatgttgcaaaacgtattgctgtctttccgtcacttgtctttccattattactgtctttcttgtttccacaagcagtcagcatcattgttcctgtaagtgcaagtacgcacattactgcaattttcctcttcataaatcatttcctcctttgattcacttattttatttggtaaaaccaactatactattttaccggttaaatgtaaatactttttaccctataaatattttttctctattttacctattatttacaccatatttttatatacttttcacaatttttatcttggtaaaactatatttttattttaaataaagttgtctgtttttacttgattgattttaaccctttatttttagctaaaaaatcataacaaaacaatctgtcatcactcgatctgtatacataaagagactataggacattctccgttccatagcctcttacttttttaccttattaaaattttttaacactgtcacgtatataaagtttagtcgggattgaaacttttacacaaatctctcttccatgtataattcgctcttccagaagttttactgcatattctcccatgaactccatgtacaatctcaccgtagtaagtggaggaaccatgtatttcgcagttgggatatcattaaagccaataatactgatatcatccggtattttaagcccaagttcatatgcagcccgataacttcctgctgccatcgaatcattcgcaacaaacaaggcagtcggcagattcccttcctcgtaaaactctttcagaagtttgtatccatattttgcataataagcaccaaactttgtatattccgggtgatacagtccccgttttttcaaagcgttctgaaaatgctgtattctcgtatccagtacttcatccccctccttatcaacttctcgacagccgatcatccctattttcgtatgtccacaccctaccagataggaaacaatctcttctactgcccgtctatagtctaccacaattgaatcgaatctctttgggtttggatctgcatcaataaatataaccgggcattcccatatctctattgcttctaccattttttttgtgaatgtaccggtacagattacaccatctaatccgttgatcatctccggcgaatcatccagtttcacaatcacctttgtatatccttcttcttccagttttttttctatagcaagcctgatacaaagataataaggatcctgaagttcttcttcaggagaataagaataaaatacacctatcttcagttttcgcctgcgttttttctgtgcgcgtacttcgtattctaattcctctgcaatttcaaaaattcttttttttgtctcttcctgcgcattcaaagtttcatcatgattcaacactctggatactgtcgctatggaaacccccgcttttgccgcaatgtccttaatcgtcgccatgtccttcccccattatttctctttctttttattttctttcaatattgccttaatgcattttcccttgatgactttcctttgcaatttattcaattcattatagcacacatttcggagaaataaatagctttagtaaaatttaacttttttactgctctgtttttcaacttttacttttacctagaactttatacgttgcaaaaaaccaggcagttcacttttaaatgtgattctgcccggttgtttatttcttagaattcatctgctactatttattttctatacgcaacttcattccatcttaattcatttttgaaatctctgatctttgtatctttatcgatataaacagcttcgattcccatttcttctgcccagtcacccatctgttccggtgtcaggtcataagagaatgctgtatggtgagctccacctgccaggatccaagcttctgcacctgttctgaggtctggctgtggtgtccagaatgcagttgctaccggaagcttcggcatcggtttttctgtcttcttgcagtctacactgttgatgatcaggcggaatctgtcgccaagatcaacaagtgatgttgcgacagccggtccttctttggctgtaaatacaagacgtgtaggatcttctctgtcacccatgctaagcggctggcacttgatgctgatcggtccatctgcgattgtcgggcaaacttccagcatatgagcttccaggataccttcttttccaggtacaaggttgtatgtgtagtcttccatgaaggaagttccctttgcatctttcttgccctgtgtcatgatcttcattacacgaaccatagctgctgtcttccagtcaccttccgcaccgaaaccatatcctttttccatcagtctctgcattgcaagtcccggaagctgctgaagtgatccaagatctccgaagtgtgtaacaattgcctgataattgtttgcttcaaggaatctttcaaatccaagttcgatctgagcctgaactgccacatgttttctgaattcagcttcatctcttccttccagaaggatctgatatttgtcatagtattcttcaacaagtgcatttacatcaccctgtccaacctgagctactgcgtcagcaacttcatttaccgggtaagcatcaacttcccatccgaatttaatctgagcctctactttgtcaccttctgttacggcaacgtttctcatgttgtcagctacacgcataacacgtacatgactgctttcgatgacaccaactgctgtacgcatccagtcaccgattctttcctgtgtttctttgtcttcccagtaacccatgatgactttacggttcttatgaaggcgtgtgaaaatatgtccgaattcacggtcaccatgagctgcctgattctcattcatgaagtccatatcgatggtgtcgtatgggatttcacggttgaactgtgtatgaaggtgaagtaatggttttctcagttcttttaatccgagaatccatgattttgccggtgagaatgtatggcaccatgtaataacacctgcacagttttcatctgtatttgcttcgttgaaggttcttctgattacttcattcgtgatcagggttggtttccagactacttcgtatggaagaattcctgattcattgagggcttttacgatgatctgtgaatgttctgctacatgtgcgagacattcatctccgtataaatcctgtgatcctgtgcaaaaccaaaatttgtaatctttctgtactaacatgtttttattctcctttttgtttaattgatttactctatcttcccaatacaagttcggtcttactaagctcgcagtcgcatacgctcccgctcgctaagtgcgccgaacaggcaacgcactaaattcatgtgtcgaatgatttactacactatgtggcccatctcacgagcacagctcattcgatgctcattagcattcgcatgaaacccgtaagatagctaactgtcagcaagctgactgtgttgtctgattgatttactctatcttcccaatacaagttcggtcttactaagctcgcagtcgcacatgctcccgctcgctaagtgcgccgaacaggcaacgcactaaattcatgtgtcgcctacggctcgcattcattaagtgctttagccttgtccatagtacgcgtctttaccgtgttttctgtagtagtgtttatcctgtaattcctgtggggcaggttttacgtctggattgatcatttcgcaacgagctgccattttagctacttcttcgagtacgactgcattatgtactgcattgtgtggatcggttccccaggtgaatggtccgtggttcttgcagagtactgcaggcattgccatgtattctgtacctttgaaatgttccacaatgagaactcctgtattcttctcatatgcttcgtcgatttcttcttttgtcagattgcggacacatgggatctcaccgtacatatagtcggcatgtgtggttccgtagcaagggattcctcttcctgcctgtgcccaactggttgcccatggggaatgtgtatggacgataccacccatatccgggaacgctttgtagagttccagatgtgttgccgtatcagaagacggatttaagttgccttccacgcggtttccttccaggtctacaacaaccatgtcatctgctgtcattttgtcataatcaacaccgctcggtttgatcacaacaagcccgctttcgcggtcgattccgctgacattgccccaggtaaatgtgacaagtccatacttaggcagaagcatattggcttcataaacctcttttttcagttcttctaacattgctttagcctcctactgtgtttatgtaaaatatttcgggttctatttcatagtctctgttgcagctttcatgatcggaagcgtcttcttgaagcgttcgataaatgtattgtatccttctacatccttcggatccggatccatctttgtacccttctgtcctgcaaatacttttgcatccagataatcatccagggcttcgtcttctgccttgttgttcatgtaagatgcaagaagtgcgattccccatgctccgccttctccggctgtctccataacagataccggtgtgtcaagtgctgctgccaggatgctctgtccaacgccttttgtcttaaagagtccaccgtgtccgagaatctcatcaacgactaccttctcttctttcagaagaatgtccattccgactttcaggacttccagagatgcatataaatttgctctcatgaagtttgcaagattgaatttgctgtctggcatacgaacaaataacggacgtccttcatccaatccaacaaccggttctcctgcgaagaagttataagacatcagaccgccacagtctgcatcaccttccagagctttgttgtaaagagttccgaacagatcgttcatatcgactttcataccgaatgcttctgcaaattctttgaaaatatttacccatgcattcagatctgaagtacagttgttgcagtgaaccattgccacggcatctcctgcaggtgttgttaccatatcgatctcttcatgtactttctcaagtgctttttcaagaacaaccattgcaaatacactggttcctgctgatacattaccggtgcggactctgacgctattcgtagctgccataccggttcctgcatcaccttccggagggcataccggaatgcctgcctgaagctttcctgttgggtccagaagctttgcaccttcttcggtaagtgttcctgccttttcacctgcaaccaaaactttcggaaggatatcttctactttccaaggatatcctttcggtgcaaccagttcatcgaacttggcaagcatctctttattccagttacgtgttgtgctgtcgatcgggaacattccggatgcgtcaccaacgccaaggactttctctcctgtcagtttccagtgtacataacccgcaagcgttgtaataaaatcaatatcctttacatgctcttctttgttcaggattgcctgatacagatgtgctccgctccatctctgtggcatattgaaacggaataattctgtcagttcttttgctgcctgctctgtcattgtatttctccatgtacggaacggtacaagctgttctcctgctttgtcaaataccatatatccatgcatcatggcactgaatccaagtgctccgacagtagtaagctctacgtcatactgcttcttcacatctacggcaagatctctgtagcagtcctgaaggccagtccagatatcctctaacgtgtaagtccagacaccgttgtcaagacggttctcccattcatggcttcccgaagcaatcggtgcattatcttctcctaccagaactgctttgattcgtgtggaaccaaactcgattccaagagaagtctttcctgcttcgatcatactttttacatcactcattttttctttacctttcctttcataaaatatatttgatttgataaatatttttatttaatgatttttacagaactccggttgataatctccggtttcagttccacactgtccggcacttctttctcctgcataagatcaaggatctcttctgctgccttcttcgctagctcccggatcggattcttcacagaagcaagcggtacttcgcaataatttgccagatcagaatcatcgattccaatgatcgacatcttgtccggcactttgatcttctgttccagacatgtcgccgcaaggttgctcgcaacctcatcgttgtagcatacacatgccgtacatccctgaatccttcttaaaatccagctgctttcctcacgcatattgcgattacgcacatcttcggtatcaatccagacaatccgtttatcttcgatcctgatatctgcttccattaaagcttcgatataaccggcataccttctgtgtccctgcccgtcatctgccttgaaaatcgctgcgatctcacggtgtccgcactggatcagatatttcgtcgccatcttccctgctatcttgtcatcaagacttacatgcggcgctttcagttccggataatagctgttgataaagatcaccgggattccctgctccatgatctgcctgtacagatcgagatttggattaggaaggccactctttgtcggttccgctataattccatccactcttttcttatccagaatgcttttcaatataaaacgttctttgtctacagaattgttggtgatggaaatctggattccatatccggcgcgtgacatcttgttctcgatttcctgaataataccagaaaaaatatattcctgaacaaaagttgtcatcactgcgatctgcatcgttttttttcgtctgaccccgatgatgccactttcctttatataagtcccacttccacggcgtttctcgatcataccttctttttccagaacagcgatcgcatgtctgacagtctgacggcttaccccaaaccggtcacaaagctggtattccgactctatccgctctcccggctgcagttcttccgcttcaatctgttctcggatccatcttacaattccttcatattttgctgatgtttctttcacttttttcttcttttccccctgatttacatacaaatcccctgatctccttacctctaatataccttaagaaacacctgattttcaacccgtaatatgttacaaattatcgtacaacttttgtatatttttgctaagttgtatttattatatgtgtacaacttgaatacatattcgtttttcatcgaggccctaacttgtattcttctttttgtaccttttgtgcacttcttataaaacatcaaataatatggtattgttttttgatgccaccaaaacaagtataacaagcttttttcgattcacgtacttctgtaacctcttcccttcaccaaatgcagaaccttgtgcaggcaccaatctgcacttgactcaccatatacacaacaagagcagataaaagctttttcattgcctttatccgctcttgttgtttttcatccgcgctattgattttcttcgatcgccataatcatatctacacgatcctggtgacgtcccccaaggaactctgcaccaagaaatgtatcaaggatcatctttgccatctcgattccaattactcttgcaccgaacgcaatcacatttgcattattatgttctcttgccatctttgccgtatatggttcagaacacaccgctgcgcggacaccgtgaaccttattggctgccatggaaattccaagaccggttccacagattgcaactccgagatccacttctccgtctgcaactgcttttccaatcttttccccatatttcggataaggacagctctcataagaatcagttccgtaattgacaacttcatatcctttttccacaagatactctaccacctgctttttcatatccactgcagaatggtcattcgcaatccctattttcatatctcatcttcctccttcccctttatacttaatgcttacaaaaagaacaccggatgtacgatatgaacatccggtgtttaaatcctacttttttattataggcaattaaaaagtttccgtcaatacccgtcgttttctcttttcgcctgtaatatttcaagtactgttctttctttagtttttcttcttcaggcttgcaaatacagactgcagaacgatgaagaagcagaggagtgcggaaagtacgattcgtacccaccagcttgaaagtgttccctgtgtagtgatcagactggaaatcgttcctttgatcagtacaccgaacagggttccgaatggagttccgacaccaccactaagtagtgtacccccgataacggctgctgaaatcgcatccatctcaagaccttttgcctgttctacgaatccggcacagctgttcatacagaaaaggaatccgccgagtcctgcaagaaagccgtccagaaggtatgcagccatttttgttctcttaacattcagtcccatcataagtgcactctgttcatttccaccgatcgcatatacagaacgtccgaattttgtatacttcataacgattatgattacgatcagaacgatgattgcaatgataactgtcggataaatatatgccgggaggaattttcccctcttactgtaagaaccaaacggcatgtaaattttgtatttagcccatgccatgaaagttgcatttttgatagaaatcatatctgtactgatgattgatgtcataccacgtccaaagaacatacctgccagtgttacaatgaatggctggatctccagataagataccaggaatccctgaaccagaccaaagagaagtccgatcaccagtgccataagaagtgcggtataagcgcttgcgccgtgattttccatctggtttgcagcaaccatacatacaagtgctgtaacagaaccaactgagatatcgattccagctgtgatcataacgatcgtttcgcccatcgcgataaccagaagacctgcattggaaatgaacagattcaggaacatctgcggttttgcaaaacctttgtcgttaaatacgatcatacctgctgcgtacattacaacaaacagtaaaattgtaatcataaggaggaatgtcgttccgttaattttcttttttgttccggatacttttgctttcattagttagctcctcctttcactgcagcctttgatgttcttttttctttctgcactgcaataaatttcttgaataccgggctctgaaggacaacgatgactacaacaacgattgccttgtagaccggaagctgatcggctgatacattcaatccgtaaagaacggttgtaagtgcctggattgtataagctccgatcacagatcccatcaggctgaacttaccaccaccaagggcatttccaccaagggcaactgcaaggatggcatccatttcaaggttcagaccaatgttgttggcatctgctgagtagatacggctggaagccacaaatcctgcaacacctgcaagtacaccacagatcaggtaagtaaggaacttgatcatggttgaattaagtccgaccagtctggatgcggttccattaataccaacgctctcgatataaagtccaagagctgtctttttcaaaataacatatgcaatgataactacgataattgcaattacaactggcatcggaatcgggaattttccgacatagcttccgaatacctgataagatttcacacggatatatgtaatctgtccgtctgtgatcagctgggcgataccacgtcctgctgtgtaaaggatcaatgtcgcaaccatcggctgaatattcagctttgcaaccagaaatccgttaaatgcaccacagattcctgaagcaaccagtgctgcaaggaatgcaacgataatcggtgctgacagagagtttacagatacttccccaccggaaaggatctggcagcatacggctgctgcaactgccataacagctccgacactgatgtcctgtcctccggaagctgctgtaacaagtgtcataccaactgacaaaataaccagctcggatgcacggttgatcacatcgaccggatatccgtatggaactccattcttaagagacatgcttaagaagcccggaattgtaattgtagctacgataatgattgcaagcagacacaccagtggcatgaaaagcctcatagaggtaagctttttccatgttgatttatttgtgctcattactcttcacctcctgcgattgctttcatgataccttcctgtgataattcatcaccggaaatttctccaaccttcttaccgtctcgcataactgccatacgtgaacaggtacggagcatttcttctacttctgaagaaataaatgcaaccgacattccctgatctgcaagatcaagtaccagtttctggatctctgtcttggttccgatatcaatacctcttgtaggttcatccaggatcaggaaatccggattggtaagaagccatctaccaatgataaccttctgctggttaccacctgacagactcttgatcggagtttcacggcttgctgtcttaatctgaagcatcttaatatatttatctgctgcttcatccatttcttttctgctcattggatggaacataccttttttcgcctgaagtgcgataataatattttcacggacagacagatctgcgatgataccatctttctttctgtcttccggaagatatgccataccaagcttcattgcatcgatcggagcatgaatcttcacttcttttccgttaactttcagtttaccggaatccgctttatcagctccataaattgcacggacaagttccgaacgtccggatccaagaagtcctgtaaatccgacaacctcacctttgttgatcgtcatatcaaacggtttgatcgttcctttatggccaagtccttctgcctcgataaccgggatgaattctttgagttctgcatgatctcccttgatatctgcaagatcatcaaagtctttacccatcatcttggcaacaagcataactcttggcagatctttgacttcgtattcgccaaccagttccccatttcgtaaaactgtgattctgtcacagacctcatatacctgttccaggaagtgtgttacgaaaataatacctacaccttcatctttcagtctgttcatcagtttgaacagctttgcaacctcatcatcgtccagagatgaagttggctcatcaaggatcagaaccttacatttcatatcaactgcacgtgcgattgcgatcatctgctgtcttgccagagaaacctcttccaacttctgggtagctgaagcatcaatttcaagactcttaagcaattctgttgcacgtttattcattgtacgccagtcaataaatcctgcttttcttggttcgcgtccaataaacagattttctgccaccgtcaggttcggacaaaggttaacttcctgatatacagtactgataccattgttctgtgcgtcctgaggtgatttattaataatcggaccgtcttttccatccagacggatctcgccattttcaaattcatgtacaccggtaagaaccttgatcagtgtagatttacctgcaccgttctcacccatcagagcgtgaatttcgcccttgcgaagtgtaaaatcaacatgctgcaatgcttttacaccgggaaatgtcttggaaatatcccgcattgtaagtacaacattaccctccatactcttccacctgctttcctttttttcaataaagagggcgtagtataaatatccggcacattccgattattatctaccacgcctctctattcaaccacccttatatgtctgtcaaattatatatccgactttcctaatgcattttagtatgcacgtttgtcaagaatatcctgtgtaagtggtgttacatcaaaatctttttcttcgtctaagctgtttgtagcttttacagatttaactgtgtcatcatgagcaaagatttcttcatctacatagttctgtttatcaacgtcttcgccagcttcaagttttttgataagttcttcagcacgtggtccgtgaagtgggttacactctacatcgcattcgatctttccatcaagaacatcctgaagtcctgcatgtgttgtatcgaaagaaattaccatgatttcgccgttagcgatatcagatccaactgtcttacctgctgcttcgattgcatcgattgctccgaatgcttcgttatcgttctcgcagtatactacgttgatgttgtcatactgtttcagcatagactccataacttcctgacctttagcctgtgtaaattcacctgtctgctgagccacaagatcccatccgtatttatcaacgccttcttcaagaccttttgtacgtccgatctgagctgtagatccgattgttccctggatatcagcgatatggatatcagatgctgcgattccttttgcttctgcaaatccgttcagccattcagctgctttacgaccttcacaaagagcatcggttccgatccatgttgtgtaaaggctgtcatcagatacatcaaccatacggtcaacgatgattaccgggatgtctgcatcttttgcttcctgaagaactgtatcccatcctgtctctgtaacaggtgcaagaagaatgtaatcaacctcctgctggatgaagttacggattgctgtgatctggttttcctgtttctgctgagcatcatcaaagatcaggtcatatccgttttctttgctgaatgtgtctttcattgactgagagtttgctgtacgccagtcagattctgcacctacctgtgagaaacctactgtgatcacatcatcggatgagcttgatgaatcactgctcttgtcgctgctgtcagatcctttgcttccaccgcatccaactgctaaagctgctgtcatcgttgcacataacaatactgctaacacttttctttttttcattttacatgttcctccttcattgggttttcttaacctcttgatgtacttataataataaaattttcatacttttaaaacagaaaatcttcctcttttggtagaatattttctgcttttccgtgaaaaagttagtttttttatgatagaagttgaatatttttagccgctatgatgatcgtcgcatttgtgccttcattttccttgctttcaaagaacactccgtattctcccccgtaataatacttgattctctggttcacattcgatacaccaaagcccttcgcttcatctcctgtatccgtccctgccatctttttccggagactgttcagttcttcctctgtcataccttttccattgtcaatgacctggaaaatgattttatctccctgctttttaccggtaatcaggattttacctttcccccgcttattcttaattccatgataaagcgcattttcgacaagaggctgcagtgtaagcttcggtataatgtagccgtagatctcctcatccatctggatctcatagtccaggatatcctgatagcggaactgctggatctccagatagctctcaatatgcgtccgctcttcttttactgtaatataatcatgtcctttgcttaaggttgtgcggaaaaaatcagagagcgaggttaccattttcacaacctctgcacttttcttttcctcagcaagccagacaatggcatcaagagtattgtaaaggaaatgtggattgatctgttcctgcagaagtcggttctcaataattctgagattttcctgttttttccggatatcatctaccagaatcccgatttcctctgtcatatcgttaaagctccgcgtgagcaccgcaatctcgtcccccgcttcgacctgtgtttttacagagaaatcaccgccggcaaccttctctgtcagatcacacagatcgcggatcggtcttgtcacacttcttgctgctcgtccactgagcagcagggaaatactcatcgcaacaattgctactccgaccgccaaaatggtcgaattacggttattccggttcagttccgtctgtacagtcacaaaattggaagtttccagatagacatagtcctggattccggtctctaccagtgtcgtcagatctttgacattactgttaaaatattccattctctcatcataagaagtccgttctttaatctgtttatccagatcctgtacacaaaaacggagtgaagacagtgaatttttaatacgtcccgcctgtgactgggtgagcggaaccgtcgcattttgcgtcattttatcacacgcctcttccatctccgtaatatagtcgtatggattcaccgtcactactccatttaccgttgtaactccatctccgacctccttaagctgcttattacttaccacagcaagatacacactatagtccagccgacttttaaagtctttcacataacggttggcataggcaatactttttgtaatctcagaataagctgatgccgcattatttaaagacacgatcaaataggcggccagaattaccattggcagaaatgctgacagcgaaatggaaagcagtttcttattgatcgaccagttcttatatttcaccttcatattttatccccttcctcttgaacggaattccttcggcgaacatccctgtgtctttttgaatatatagctgaaataatgggaatctttgtatcccacctcatatccgatgtccgatgtcctcttatccgaacacatcagaagctcttttgctttttccatacgaacacccgtcagatattctacaaaggttgagccaacctcctgactaaacaaagagctgaaatagctcggactgatgttgacgctcgaagccaccaggttcagtgaaatattctctgacatataattttgtccgatataatctctcgctttttcaataatttctgaatagcgtctgcccgatgcctgctctcttaaccggatcattcgtctgactatattttccaggtacttcctcgttgcctccagttcctgcacatactgcgatacctcctgcacatcgccaagctctctttcaatatcttctttttcaatgttcaaactatctcccagactttgaacgctgataaaagtatccattacaatatactgtctcaacatcatcgactgcaggttctgctcaccaattgcatcaaaatatgcatccataaagctttttacttcattttccgttcctgtcttcaggaaacgctccagcattttccgattctccgccatggttccgagtctgtgcatctcaacgtcattctgaacccccacttgatgaacctctgaataactcacaaactgtctcaaacttctcgaaaaacgctccgcaaaggctctgtttgcatcattgtaggatctttttatctcactgaacctccccacctgacttccaattcctccaaaatattccagatttttatatttttccagaactttttccagatcttccctaaatgtctgagctctcgcagtcagttcttcaccaacagctccctgtgcaataaatccccatccttctacacctctccggaaccacaggagcttttctgtctgctcactcagattttctatatcttcagttgcacttacaatatcctcgttataatccatcggatgatcgatcataatgatcttaaagaggatcacacaatatccctctgcactgatttcaattcccagctgctttccctgctccagacattctccaaatggcatacttcctgcaaacacctgattgaaaaactgaaacttttcactttctttgttttcctgcatttcacgggcatattgattcatctgctctttttcactttgctctttccggatttcttctgctactttgttaactgcatccaacaatttttctgaagaaattggcttcagaaggtaatcggttacaccgatcttaatcgccatctttgcataatcaaactcattatatccactcagaatcatgattttcgtagccggaagtacttttttaacctgctcactgagttccagtccatccataaaaggcatcttaatatccgtgatcaggatgtctggttttttttcaagaatcatcggtaacgcaagttctccatcacttgcctctccgacaaagtcatatccatgcatttcccaattaatactgttcttgatcccatttctgataataatttcatcttcaaccaaaaatacttttatcattcttcttcctgcctttaatatgttctgttttctataatttcatccaaatccatagttccatcaaaatatgtttcttccacgtattgttccttatcaatggaaatatccgattccagtctctggatcagttctgccgctttcggtccctggccaggattgcattcaaaggttacattcaatttaccttcttttacagcttcgatccccgctttgcttccaccaaatgaaatcacaataatatctccgtcctctccacaggtctttcctgatttcccgatcgcatcgatggctcccagtgccatctcgtcactctcagcaaacactacccgtaaatccggttcctgctcaagaaatagtttcatgactttctctgcctcttctctggaattgtcaccggtctgttgtgccaccatctcccagtccgaatacctctccagcatagtctgatatccctgcgctctcgtcagctgctcttccgagccgatggattcctgaatcgcggcgatcttgatggtaatgtcttcttctgtctgctcctcctctgtcgaatccgcctcatccttcgccgttgaactgcttttcataattttattaaaaatggatgcactgctatctgtcgcttttgaactgtctgtatttacttccgtatcttcactgtccgtctgttccgattcttcctgagtcggtgcctcagaagccgccttttctttctctgcctttttctcctcctcttctttcagatattcatccaaccattttcctgcctttttcatctgttttccgtaatcacttccaagcatgcacgaatacagactgctgtcatccgtatcaacaccgttattcacaaggattacaggaatatgtgccttttttgcatcttccagcacatcatcccagccaatttcagaaatcggattcagaatgatatagtccacaccctgttttataaatccttccacatcttcaatctgtttttcctgatcgctacctgcatctgcatacaccgcttcatagccgtttgatttgacaaatgtatccataaaagacgctgtatttgcatccttccatgagctttcttctccactctgtgaaattcccactgtgatcagataatcgaactcgctttgcagattatccccatttcttgtctctcctgtaaataaagaaagtgcaaatgtacccgccgatacaatcaatatcaatactgccgcaacctttaaaataaatcgtcctacacgtcccatgtcgttcctccttcacgtctgttaaaggacattcttttcagatgttttctattatacactgacttttatcagaaagaaaggtagaaatcgagcagaccagctcactatatacacaaaaaaccacagacataaatgcctgtggctttcgatctcatttgattatacaagctcaagaataacttccattgcagcgtcacctttacgctgtccaattttgatgattcttgtatatccgccgttgcggtctgcatacttcggagcgatctctgtaaacagtttgtctaccagatcaacttcttttgtatttttcttctttccagctgcagcagtcggaacttctgttacagggtaaagtactttcagcatctgacgtcttgcatgaagtcttgacggattatcttttttgattgtcttttcaacttcttcgtatacagtaactttcttaccatctactacttctttaactctcttgccttctgcatctttcttagcaactttagctttgattgtaacttcttcgaagttatctttttcttttacagctgaagcgataagaccttctgcgatcttacggatttctttagctttagcttctgttgttctgatttttccgtgctgaagaagcattgttacctgatttctcagtaatgcttttctctgacttgctgttcttccaagttttctatactttgccatttttttatcctccattattcgggacataccggcatgcactttcggtcttactgcggatatgccatctggttatgctttcatcgggcttactagccagatcgtgtgtcagtgtttctgcctgtattcacatgcgaaacgggaactccttattcgtctccctggctgagttcaagaccaagttcttttaatttagcaagaacttcttcaagagatttacgtccaaggttacgaactttcatcatatcttctgatgttctgtttgtaagttcttctacagtattgattcctgctctcttcagacagttatatgaacgaacagaaagttcaagttcatcaatactcatttcaagaactttttctttttcatcgtcttccttttcaatcataacttccgctgactgagcaacttcagaaagatcaataaagagcttgagatgttcatttaatacttttgcagcaaggctgactgcttcatccggtgcaagagtaccatttgtataaacatcaagtgtgagtttatcataatcggtaatctgtccgacacgagtattctgaactgtaagatttacacgctcaaccggtgtatagatagagtcgatcggaatcacaccaatcggcatatcttctgtcttattcttatcagaacctacatatcctcttccctttgtgatagtcagttccatataaagcttgctgtctgcaccgccgttaagtgtagcgattacagtttccggattcatgatttcaatatcagaatctgcctgaatatcagcagctgtaactacgccctctccctcaaattcgatgtaagctgttttcggctcatctgtctcggaagaattcttaattgcgagtgtttttaagttcatgataatttcagttacgtcttcctttacacccggaatagaactgaactcatgcaatactccgtcgattttaatctggctgattgcagctcccggcagagaagaaagcataatccttctcagagagtttccaagtgttgtaccatatcctctttcaagtggttctacaacaaatctgccatacttcttatcatctgaaatttctgcaatttcaatattaggtttattaaaatcaaacactattttggtccctccttatgggtttttgtatgttgagggtgtcagtttttgtcctgttttcgataaaaaacaggatatttcctaacagaaccttaacgaacccaggaatcaggttcgttaagtattgcattttatatgaatgcgttctatttagaatataactcgactatcatcatttcgtcaactggaacatcgattgcttcacgagtaggaagttctttaactgttcctttcaggttttcgatatctgattcaagccattccggaacaagacgtccacctgtaacttctacgatatctttgtatctctgtgaagattttttaccttctttaatctcgatcacatcacctgctttaatgaggtaagaagggatgttaacctgttttccgttaacaagaacctgtttgtgatcaacgatctgtcttgcttcacgtcttgttcttgcaaatccaagacggaatactacgttatccagtcttgattcaagaagaaccatcaggttttcacctgtcattccgctcatctgatctgctttcttgaagtagttcaggaacggtttttctaatacaccatagatgaatttagctttctgcttttcacgcaactgaagaccatactcgctcatttttctattggatctctttaactgtctgttagactttttatcaattccaagatataccggatccattccaagggaacggcatcttttaagaaccgggactctatttactgccatgttcgtatcctcctataataattcgactagactcttcttctcttcggcgggcggcatccattgtgtggtaccggtgttacgtctctgatgcttgttacatcaattccgcatgcctgaagagcacggattgctgcttctcttcctgaacctggtccttttacgaatacgtctactgatttaagaccatgcggcagagctgctttagctgctgtttcagctgccatctgagctgcgtatggagtagattttcttgaacctctaaaaccaagaccaccagcacttgcccatgataaagcatttccctgtgcatctgtcaaagtaacgattgtattattgaaagatgactggatatgtgcctgtccgcgttcaacgtttttcttgacacgtttttttgtcactttttttgtaactttcttagccatttaaactaacctacactttcctttttattatttgtcgaaattatttcttcttgtttgctactgttctcttaggaccttttcttgttcttgcattggtctttgtcttctgaccacgaaccggaagtccttttctgtgacggattcctctatagcatccgatttcctgaagtctcttgatgttaagagcgatctctcttctaagatcaccttcaactgtctgagtttcatcgatcactgcactgatctttttaacttcgtcatctgtaagatctctgcagcgagtatcaggattaactcctgcttctgcgagaatacgggttgcacttgttcttccaattccatagatataagtcaatccgatttctacacgtttgtctcttggtaaatctacacctgcaatacgagccatttgtgatttcctccattttctttctttttttggtttcacattgtcctataatgaggctgcgggcatcccgttatcaaaaagagccctaccggacttttcaaaatgtatccaatgcctcagacacgtccgatatcccagcccagatgcggttcggtatccgcatcctttccggcaaccgatctctcggctaatgaccgccggtttttaagcaatatactagaaaccacttgcccgtggtgttcatgtatattaaatagtggataacgctctacacacaccctggcgtatcctctatcagccgcctaattaagtttacataaatctgtctttcgctgctccgtgcgcctaagttcctctgtcgcctacggctcgtcgtcactaaggcttgggagcggtcttttcactaaattcaagctgcgcctgtggcttgctttcattaagtgttcagaacctatccctgacgctgtttatgtttcggattctcgcagataattctgacgcttccttttctcttgataactttgcatttttcgcaaatcggttttactgatgatctaaccttcacgtcaaatcctcctttcataccttgcctggtctgcattttccccctgtgcgcagaaaaagtccctcgcacagttcgcataaaattatatcacctggtttttagttttgtcaagtaatattttatttatctctccagataattcttcctttagataaatcgtatggtgacagttccagagtaactttgtcacccggtaaaattttgataaagttcatacgcagctttccgctgatatgtgcaagtacctgatgtccattttccagttctacctgaaacatggcattcggaagtttttctactactgttccttcgatttcaattacatctgctttagacatttatttgtcctccttcttttctgacatcttatattcttttaatatccgtttcagctttacatcatccgcttcggaaatctcatgctgttctctaatgagctgtacatgtttctttttctttttctttggactctgaagcgttttcctctccccgtctgcaagatatgtaaactgttcatccagtccgacgatcacatataccttatctttatcatgaccggccagagatttcgcaagcattcctgtttcccatctatccattttctgttcctctgttctgttatacatttccatctgcaatcgacaggatcttcggttcgtcttttgtgatcagaattgtattttcataatgtgctgattcttttctgtctgccgtcaccaccgtccagttatcactcatccagcgaatccgctctgttccgagattgaccatcggctcaattgccagtgtcattccggctttcagcttcggtcctcttcttcgcatctggaaattcggaatctccggtgattcatgaagactggtcccgattccatgtccgcacagttccctgacaacaccgtatccaaagctttccgcataatcaccgattgctcgggatatatcatatagatgattgccttcttttgcgaactttattccttcgaagaagctttccctcgttacatcgatcagtttctgaagatccggtctgatctcaccgacagcatgtgtccttgcagcatcggaatgataacctttgtagatcactcctgcgtccaggctcacaatatcaccttcttttatgaggtgctttgctgacggaatcccatgaacgatttcatcatttacagaaacacagatagacgccggatatccattgtaattcagaaaagaaggttcgcagccatagctgcgaataacttcttcacctaatgcatcgatatccagtgtactcattcctggttttaatgccttctccagttccttatgtacgatccccagaatccttccggcttctgtcatcagttcaatttctctttctgatttaatcgtaatcggcatctgttactctcctaatatagaaacaatggctccgaatacatcttccatatccactgttccatcaacgcttttcagaattcccgcttttgtataataatcgatcagcggctgtgtctgatcatgatatacatgcagcctcttttcaactgtctccggtttgtcatcatcacgaaggatcagctctcctccgcagacatcacagattccgtctttctttggtgcagcatatacaagatggtaagttgcgccacatcctacgcatgcgcgtcttccacccatacgctttacaatattctcgtccggaacatctacatcgattgcatagtccatcttctgtcccttcgcttccagtgccttatcaagcgcctcagcctgtggaattgtacgtgggaaaccgtccagtacatatcccttcgtacagtcatcctgactcacacggtctacaacaagatctacaaccaattcatccggaacaagaagtccctgatccatataagtcttcgctttctttccaagttcagttccgttcttaatatttgcgcggaaaatatctcctgttgaaatatgaggaattccgtacttagcggcaattttttttgcctgtgtaccttttcctgcaccaggagcacctaacataatgattttcattttactattcctccttcaaatgtcataatggcaaaagagcccgttgtctttgattatactctaaaagacaacgggctacaattgttttaatatccaagaaaactatttttcatagattttcctttgacattcaaaaatcctgtgtaattacgaacgagcatctgagactcaatctgtttgagtgtctcaagaacaacaccgatgataatgatcagagaagttcccccgaatgatacattcgctccaaacacaccattgaacacaaacggaattacctgtacaattacaagtccgcatgcaccaataaagataatataatttaatatcttatttaagtagtccacagtaggttttccaggtctgatacctgggataaatccaccgctttttttcatattatttgcaatttccaacgggttaaaagtaatgctcgtatagaaatatgcaaagaaaatcgtaagtacgatatatactataagtccccaggaatagtaaatcttattcggattacaccagtttcctgaacttaagcctctgaggatttcacttccgatgccttttccgttgcccttgcccataaatgaagcaattacaaccgggaactgcataatagatgaagcgaaaataaccggaattactccggcggtattaaccttcagcggaatgttcgttgactgtccacctactgattttctcccctgtactttctgcgaatactgaaccggaattcgtctctccgcatcctgaagtattaccgtaaatactacaagtacgagaatgattgcaatgatgatgattgctgcaagtcctccactggcaagacctttgccgctgatgaacttctcatacagtgaggtcatatcacttggaatgcgtgataaaatgttaatgagcaggacaatagaaataccatttcccactcctttttctgtaattcgttccccgatccacataaggaatgcagatcctgcagttaatgtaagaactacaattgcagcatttacaaaattgaacttttccaaaagtccctgacgtccaaatccaacagccatagctgtagattcaatcagagcaagcacaactgtcacataacgagttaatgcggtaagcttctttcttccatcttccccttctttctgcatttcctcaagctttggaattgcaattgtaagaagctggatgataatggaagatgtgatatacggggtaatactcaatgcaaagatggacatcgtctcaaacgaaccgccggtgaaagcgttaaaaaagttaaacgaatcaccggtctggttcgcaaagaaattctgaatataggtcggatcaactcccggcgtcggaagctgagatccgagtcttactacaaacagcattgcaagggtatacaatatttttctccgtatgtcttcaatctgaaatgctttacggaatgtttgtagcattagatcacctctgcttttccaccaacagcttcaatcttttctacagcacctgcgctgaatgcatttgcctgaacagtaagctttttggttaactctccatttccaagaattttaacaccatctctggcatgttttacgattcctgcttcaatcagagtttcaacagaaactactgcatcgttgtcaaatacttcaagagcactgacattgattccaacgatttccttagagtttctgcaagtgaaacctctcttaggaatacgtctgtataatggcatctgtccaccttcgaaacctggtctcggagctccagaacgagctttctgacctttgtgtcccttaccagcagtcttaccatttcctgagccgtgtccacgacctcttctgaaattatcgctatgttttgatccgtcagccggtcttaaattagataagtccattgtgacacctcctatctaagatttatgcttcttcttctacttttaccagatgtcttacctgctgaaccattcctctggttgcagcgttatccggaaggacaactgtcttattaaccttcttaaggcctaatgcttctactgttcttctgtgtttcggaacagcaccgattgttgattttactaatgtgatttttaaatttgccattgtaatctcctccctagcctaagatctcttctacagttttaccgcgaagtttagctacgtcttctggagctttcagctgacttaaaccttcgatagtagcaagtactacgttctgtttgttgttagatccgagagattttgtacggatgttcttgatacctgcaagttcgattacggcacgagccggtccacctgcgataacaccagtaccttccggagcttttttcagaagtacagaagcacttccgaattttccaatataatcatgtgtaatactgtcgttttcatctaaagtaactttgataagtttcttcatagcatcttcttttcctttgcggattgcttccggaatttcagctgcttttcctaaacctgcaccaacatggccgtttccgtcgccaacaactactaaagctgtgaatctcatgttacgaccacccttaacaactttggtaacacgtttgattgatactactttttcggtaagttctaactgattagcatcaatacgttcctgtttcatgtgtccgtcctccttctagaaattcaaaccagcttctcttgctgcgtctgctaatgctttgatttttccgtgatagataaatcctcctctgtcaaatacaacagaagtgatacctttctcgattgctttttttgcaattactgttccaaggtatgctgctgcttcaacgttgttggttttttccagttctgctttcacatctttctgaagagtggaagcggaaaccagagtgtttccaactgtatcgtcaataatctgagcatacatatgattattacttctaaacacagcgagacgcggtctttcagctgtaccactgaaacggttacgcagttttctatgtttatttacacgaacttcgcttcttgatttcttactaaccatttgttcacactctccttacttattttttaccagttttaccaactttacgtctgataacttcatcagcatatttgattcccttgcccttataaggttccggtcttctcttatctctgatttcagctgcgtactggccaactttttctttactgattcccttaacgatgattttgttctgtccgtcaagaacagtttcgattccttccggatcttccatctcaaccgggtgagagtatcccaaattcaatgttaatttgtttcctgatttggaagctctgtaacctacaccgtttacttcaagaactttttcatatccttcagtaacaccgattaccatgttgttgatcagtgttcttgtaagaccatgaagagatttcatcttcttgagatcgttcggtcttgttacgataacttcttcgccttcttttttgatttccatttcaactggaagttctcttacgagagttcccttaggacctttaacagtcactacattcttctctgcgatttcaacagttacgcctgccgggatcgctactggatgtcttccgatacgtgacataccttttacctcctacacttacattttcggaacagcaccttatggctgctctgttttcagttgcaatttattgagtatcgaatgaaatcacaggaaatatgatttcattcgttttctccattttatctggttattaccatacgaagcaaagaacttctccgcctacgccgagctttctggcttctttgtctgtaatcacgccctgatttgtagagatgattgcagttccaagtcctccaagtactctcggaagttcgtctttaccagcgtaaacacgaagacctggtttagaaatctttttgattccagaaataactttttcgttcttatctgcaccatattttaatgtgatgcggattgtgttgaagtttccttcttctacgatgtcatattttgtgatgtatccttcgttaacgagaatgtcagcgatagcgatcttcatctttgaagccggaacatctactgtatcatgttttgcagtgtttgcgttacggattcttgtaagcatatctgcaattggatcactcatagtcattgtggattatcctccttttctaccaacttgctttctttacgcccggaatttcacctttgtatgccagttcacggaagcatacacggcagattccatattttcttaaatatgcatgtggacgtccacagattctgcaacgattatattctcttgtagagaatttctgtttgcgctgctgtttcagtttcattgctgtctttgccatgaaaatttcctccttattttgtgaatggcatgttgaactgtgttaacaattcacgtgcttcttcgtctgtattagcagttgttacgaagataacatccatacctctaaccttatctactttatcatattcgatttctgggaagataagctgctccttgataccaagagcgtagttacctcttccgtcgaatgcgttcggattaactcctctaaagtcacgtacacgaggcagtgcaaggttgatgagacgatcaacgaactcatacatcttttctcctcttaaagtaactttgcatccgatagccattccttcacggattttgaagttagctactgaatttttagctctggtcagaactgctttctgtccagtgatcttttccatatcagctacagctgagtctaatgcttttgcattgtcttttgcttcgccaacgcccatgttgataacaaccttgtcgagcttcggcacttccataatattcttataaccaaattttttgatcattgcgtcaatgatctcgttctggtactgttctttaagtctactcaaagcctttgacctccttcctagaactaatcaattacttcgcctgttgattttgcaacacgtacttttttgtctccatcaagtttgaaacctactcttgtagcttttcccttgtgaacatacattacgttagatgcatcgatcggtccttcctgatgaaggattccgccttccggattagaagcgcttggtttagcatgttttgttctcatgttaacgccttctaccaggactgtaccgtttttctgatctactgcgattactttgccttctttgtctttatcttttccagcgataactttaacggtatcgccttttttgatcttcattgttgacatactcgaacctccttacagtacttccggagccagtgaaacaattttcataaactgtttctcacgaagttctctggctacaggtccaaaaatacgagttccttttgggtttttgtcatctttaataataacagcagcattttcatcgaatctgatgtatgatccatctttacgacgagtgctgtttacagtacgaacaactacagctttaacgacatcaccttttttaacaacgccgcctggtgttgcatctttaaccgaagcaacgattacatcaccgatagctgcatatcttcttgtagaaccgcctaatacacggatacagagtaattctttagcacctgtattatctgctacttttaatctgctttcttgctgtatcatgcaggtaaacctccttatacttttatcaaagtcaaactatttaactttttctacgatttcaacaagtctccatctcttatctttagataacggtcttgtctccataacttttactctatcaccaatattgcattcattattttcatcatgcgctttcagtttgtaagttctttttacgatcttattgtaaagcggatgttttacatggtcttctactgcaacgacgattgtcttgtccatcttgttgcttacaaccttaccaactctcgtttttctcaggtttctttccacggttatactcctttctgaatatcacctaattaagcattctggcttttttctgtgatcactgtctggattcttgcgatattctttcttacttctttgattctgcttgtattatctaactgatttgttgcgttctggaatctcagattgaagagttcctttttagcagctactaattcttcatttaattctgcaacagattttgcttttaaatcttctacaaatgtcttaattttcactgttatcaccgccttctaagtctgcacgagaaacgattttacatttacatggtaatttgtgcatagcaagacgtaatgcttctttcgcaacttcttcaggtactcctgcaagttcgaacattacacgtcctggcttaactacagctacccagtattcaagagttccttttccagaacccatacgtgtctcagccggtttcgttgttactggtttatcagggaagatcttgatccaaaccttaccaccacgtttgatgtaacgtgtcatagcaatacgggcagcttcaatctggttagatctgatccaacatggttccattgctacaagaccatattcaccgttcgtgatcttgtttcctcttaatgctttacctttcatggagccacggaactgttttctacgttttactctttttggcattaacattatttatcgctcccttccttacctgcctttgttggaagtacttcgcctttgtaaatccataccttaacaccaacttttccgtaagttgtgtctgcttcagcgaagccatagtcaatgtctgctctcagtgtctgaagcggaatagttccttcgctgtagaactctgtacgagccatatcagctccgccgagacgtccggatacggatgtcttaacaccaagtgctcctgatttcatagttcttgacatgcaagatttcattgcacgacggaaggaaatacgattttccagctgctgtgcgatgttttcagcaacgagctgagcatctttgtcaggtctttttacttctttgatgtcaacgataactttcttatctgtcattttctgaagttcagcttttactttttcgatctcagaaccgcctttaccgattacaacacccggtttagcagtataaacgatgatcttaacacgatcagaagctctttcgatttcaatcttagaaactcctgcgctgtataatttattcttcagaaattttctgattttatgatcttctactaaatagtcagcaaaatctttttctgcataccatttagagtcccagtctttgataacaccgactcttaagccatgaggattaactttctgtcccattattgccctccttatctttcattaagcacaagtgtaatatgactcattctcttttcgattctgtaagctctgccctgtgctctcggtctgattctcttcattgttggtcctttatttgcgtagcattcctcaatataaaggttttcaacactcataccgttgttattctcagcatttgcgatagctgattccaataatttctttataatgcttgaagcgtatcttggattgtatgttaaaataccaagcgctgttgttacatccttacctctgatggcatctaatacgaagcatgctttctgaacagaaactctggcgtaagataacttagctgaaggtctggtgtccttgtttgcatttctttctctcttaatttgacttctatgtccttttgccatgggatgaaacctcctttcaatacgttaaatattatctaactttcgatttcttttcgtcttttccatgtcctctgtatgttctggttgctacgaactctccgagtttatgtccaaccatatcttctgttacatataccggaacatgttttcttccatcatgaactgcgattgtatgtccaaccataatcgggaagattgtagaacgacgagaccatgttttgataacacctttgtctcctgatgcgttcattgcttccactttcttaagcaggcttgcgtctgcgaatggtccttttttaagtgaacgagccataggttctaacctccttgaaaattaactatttgattcctctaccgtcttttcttctgatgatcagcttgttagactgtttgtttttcttacgagtcttaagaccaagtgccggtttaccccaaggagtgcacggacccggacgaccgattccagtcttaccttcaccaccaccatgcggatgatcattcgggttcataacggaaccacgaactgtaggtctgatacccatgtgacgtttacgtcctgctttaccaatgtttacaaggttgtgatcgccatttccaacaacaccaactgatgcgcggcattcgatcggaaccattctcatttctcctgaaggaagacgaagtgttgcatactttccttctttagccatgagctgtgcgctgtttcctgctgaacgaaccatctgtccgccctttccaggatgaagctcaatgttatgaacctgtgtaccaaccgggatagctgaaagcggcaggcagtttcctactcttacttctgcttctggtccgttcataactttcattccgtctgtaagtccttctggtgcgatgatgtaagctttttctccatcagcgtagcagataagtgcgatgttagcacttctgttcggatcgtattcgattccgattacagttgccggaattccgtcttttttacgtttgaagtcgattactctatattttctcttaactccgcctccgcggtgtctaacagtgattttaccctgattgttacgtccggcagtcttgctcagagaaactactaaagatttctccggtgctgtttttgtgatttctgagaaatcagagccggtcatatgtcttctggaaggtgtatatgggcggtatgttttaattcccattactctatctcctttcgcattttgctagttatttttgtcacggatttgcaccgtttaggttccagtttcttacagtccctggaagatttcgatctctgctgattcttctgtcagctgaacgattgctttctttgtcttagctgtttttccgaatgtcatggttccgcgaactcgtttgttctttccgtccatgttgattgtgttaacgccagcaacttttgttcctgggaacattttttctacagcttctttgatctgagtcttattagcttctgtgtgtacaaggaatgtgtatttcttgtcagccataagagccattgtcttttcggttactaccggtttaaggattacatcataatactgaatgtttgccattatgcgtacacctcctcgattgcctgtacagcagccttagttgcgattactgtattgtatttcaggatgtcatacacattgattgtgtttgtcttagcagttttaacatcagcaatgtttctagctgaaagttctgcattcttgtttccgtcttccagaactacgagagctttggatactgacaggttattaagaacatcctggaatttctttgtcttgatttcatcaaagttaatttcatcaacaacgatgaatttcttttcttctactcttgatgtcagagcggatttgagagctgctcttctttctttcttgttaagtttgaaagagtaatctctcggtgtcggagcgaatactactccaccgcctgtccactgcggagctcttgtagatccctgtcttgcatgaccggtacctttctgtctccatggttttcttccgccgccggaaacttctgaacgagttttcgctttctgtgttccctgacgtttatttgcaagctggcttacaactgccatgtgtacaaggtgttcgtttacttccacaccgaatacagcatcatttaagtcgattgttccaacttctttaccttcgatattgtaaacagatacgtttgccatctgtatgttcctcctttcctagtgccaatcttagatagattttacagattctttaatcgttacaagagatttctttggtcccggaactgcgcccttaaccagaagaaggttgttttcaacgtctactcttacgatttcaaggttctgaattgtaatcttctttgctcccatgtgtcctggcatctttttgcccttgaatactttactcgggtcagatgcagcaccgttggaaccagcatgacgatggaacttagaaccgtgagccataggtcctctgtgctggttgtgtctcttgatagcaccctggaatcctttacctttggaaattgctgttgcgtccactttgtcgccagcttcaaagatatctgctttaatttcctgagctaactgatattcatcagcgttctcgaatttgaattcttttacaaatctctttcctgttactccagctttatcaaagtgtcctttttcagcctttgtaacaccgtgtctgtgcacgatttctttctttccgttcttgtcaacgttaacaattttgtctttcttgtcaacgaatccaacctgaactgcgctgtatccgtcattttcaacggttttgatctgtgttacaacacatggtccagcctgaagaacagttaccggagtaagtactccatcttcgttgaagatttgagtcattccgactttggtagctaagatagctttcttcattttattttacctcctgtgatttacagcggaacgcccttatgggtgttcatcctaaatattaggaactactgtgttttaatttattagaacttatttgttcttcattttgatatcgatgtatacaccagctggcatttccagtcttgacagagcatctacagtcttctgtgtcggtgcaatgatatcgatcagtctcttatgagttctctgttcgaactgttctctggaatctttgtatttgtgaaccgctcttaagattgttacaacttccttctttgtcggaagcggtaccggtccgctaacctttgctccatttttctttacagtttcgataattttcttggcagatgcatctacaagctgatgatcatatgccttcaatgtgattctcattacttgacttgccataaaaaaagtcgcctccttttcgtacttaaacctcagtacgacaagcggtgactgtacacttccccgtgtgtgtcgtgagaaactcacacgttgttactgcatctcagcagctgttatgatttcgtacagtgacttgtcgccagtttcctaacttgacattcgctccacggaaaacctgccattcttctcggcagcaacctcgcgcttctttgctatcatgtcacagcttttttagtatacccgatgtttctgcattttgcaagcattttattttattttttgtactttttttcatacaaaattttcttgaaaaatcttctccttttgtgctatttttcttattccctttttgcggtataatattctcatattcagcggggtaccagatccataggcttcttcgctaaatgcagcctgtctttcgatctttccccacatcatcttatatagaataaaaggaggacgcatattatgcagacattagatgcaatcaaaacaagaagaacgatccgcaaatttacagaagagcctgtctcacatgaagtgatcgtgaaaatcgtagaagcaagtgcctacgctccatcctggaagaatacgcagacagcaagatatattataatagaagaaacagctctcaaagacaggattgccagagaagctgttatgggatttgaatggaatacaggcatcattcttggtgcaccggtactggttgttctcgcttccgttccggggaaaagcggttacgaaaaggacggagcttattccacctcaaaaaaggataaatgggaaatgtttgatgccggtatcgcggcgcagaccttccagctcgctgctcatgaatgtggaatcggttcggttgtcatgggtattttcgatgaggtaaaggtaaaagaactacttggtcttgacgatactctgaatgtatctgccctgattgcgatcggtcatccagccatccaaccgaccgcaccagcacgcaaacctgtccaggaactgatccagtaccgctaatctacagtagacttacgcttgaccgctttgtacagattttagtgcataatttattcataaatttaccattttcttgttgacactaccgtgataaagtgatatagtgtaaccaacttaatcagagagctaaaccaagggcggtttccaacacaaggataccgctttttaataaagacttgattaagctacaacattggttgttattgcagttatattgttgccggtcgtttcccccaagaatgatcttgcaatgataaaactccaatttatatatacatcctctttgtaggagcattccccagctttgtatataaggcaaactgcaatgcaacgaggaaaaacctctcaatgacataccaaaaagaaaagacatgacctcgaggggtcatgttttttctttccaaaagtaaaggagacgtgaaaatatgagtagttcaagaccgatagataacccgaaagatccccgtacagacgagaaacccgtattttcaaaagagctggttcaggaagatctgaaagatgaattcaaagcaggctccaactccgaatgggccactgattcccaggatgaactcgaagactggattgaggagcaggggatacagttgcggtattagattttttgttaaataaatacagatatttatgccgggaaagcttctttgacttcccggcattttttcattcgtattttcttatacatatcttatattttcaagaaatgattgcggaacacgcataaaaaccagaaaataattcagccttatattccaaagttgacttgaaattgtaaattctaaaatagagtcaccaaaacaaggtttgaaatttgattcaatattatatactgttaaaaagtcaagcaagcagatcacaaattttgaccttgaattgcataatcaaaaatcaaatcaatacaaatgaattttttgactttaaattgcaaatattaaaagtaaatcaataaaatgaggttgaaaacttgatttagaattagaaaaagcccaaaccaatcaatataataattttaaatacttgacttagaattgtaaaactcaaaaacaaatcaatatagcaagctcaaatacttgattcagaattgcaaagttcaaaagtaaatcaatatgcgaaaaggagacagattaaaaacccgtctcccatcttctatccattattcatcaattatttatcactcacgaaaatgaattttacgcttccgtccattccgtctgcgattccagagaagttcttatattctttggatgcatccagaagttcgtttgccttatccagaagtgcatcgatgtccccgtcaaatacgcttaccagtttttcaattccttcttcgttgaactggatcataccactgttcaattcagctgctccggaatcaagctgttctacaccagataccagtgcgcctgtgctgctctggagagtgttcagacccgttgaaagagttccggctccactattgagctgggatgcaccacttactagctggcttgatcctgctgcaagctgaccaagtccagatacaagaccattcgtaccatcaactccggctaacagctgagctgttccactcttaagctgaagtacaccgctatttacctggcttacaagtccatcttttccgtttacgccttcatttaattcagttgctccagctgcaacccgtttgattccatcgaaaagtgccggtgtgcctgctgctaatttttgcaaaccgacatttacagctcccgcagccgcaactgcggatggatgttgctcatcagttcctatattaaccgctgtattcaaggcattcatgttagcagccaaattatatcctccatgcacaatatcatctttattaaacgcatcgtcaatactttctgtgcctttttcaagtattgcaagatagtctaacgcttcttttacttttggattttccacttctattgtcgtatttacagttgctttcccattttccatatttgcattttctatggtagcattattgatagtcgcttcttgaatagttgcattttcaatagtagcatttccttctacactttgatcgcttgcggaaagagaatctattgctgtttgaatagcctttgttgcctcttcatttccttccactttacccaatgcctcttgcaagctatctatcgctgttttattttgaattgctccattatataatacagttgccgttcctgtagccgttcctgtagctgttcctatagctgttcctgtagccgttcccgtagcattcgatacattcacattatcgctactcacattcactttttgtttgctattatctgccacatctttcagactactatatgctttttcagctgtaccttttaatccacccgttttacttgcaactccacgaaccacatcattcagactgcttacattttttccaatgttggcaacacctgtatttaatccacttgcacctgttgctgctgcctgcactccatcatttacactctttgcaactgcaaccagactaggctgacctttcgctgcattccctgtattcaatgcagcatctaatgttgcaacccctgtcgtaagcttcggcagtgcatcatctgctgcaagcttgctctgcatctgagacaccccaatgtccaatgcttttactcccggaaggagtgttccgcttacctttgatgatgctgtctgtaatccagcattcagcgtattcgctccactcaccagactaccagttccgctagccaatgtatttccaccacttgccagctgatcaattccgcttaccagtgttcctgatgaagaaagcagtgtatccagtccgtctttcagttctccggagccgctgacaagtttgttcgatgcatcttgaagctctgtcatagaatccttcagttcacccaagctgtcaaatttatcggtacctacttcattgaacacttcgtttgttgcaactgtaacggcttctactttttcgtaatctgtcacatctgcttctactgtaaaggaatccgggatatccagatcatccaccttgctgctaactgatgtaagctgttctttcaactgtggaagtcccattccgattacgatgtttctgtcgccatctgaaattacttttccattatcaacggttacatttgagaatttctcgccatccatcagaagcccggttgccatcaaaaatggtgtgtatttcccgctgtcagcacttgtattctgatattcataatgaatctttaagtgtccactctttccttccagatcatctgcgctgactttctttccgtcaagttcataagtaaccttcattcctacaggaatcttctttgtggttgttccctgatagcagatatctttcttatctccctgccataccagtttaccgttattttcagaaaaggtttcatcaccttttacattcttgatatctttcagatctgatacatcatcaatggttccaagactcgaaatatttttcagctgatccgataccgtaacatctttctggtttcctgcgtcatctacttttacatatacagtctcatcttttgcaggtgttgcgctgctgcttgtttttgtttcgcttgttttctttgtctctgtgcttttatctttattatctgccgcctgtacatttacagatgttcctgcaatatttccaactacaagcgatgccataagtgcaagtgtaactaatactctgtattccctgttcttcatgtttaaaaacctcctgtaagcctctactgactttcctgtcggtatgctttcttctttttgactactggtcattttctagctcgcacttactataactcaaaaatgaccacaagtcaatatttttctacaaaaaagttgactctgagtcattttgattttataataaagataattcaaaggaaaagaggaatgaatcatgggaaaagtagatgaaaacaagcatcagaaaatggatgctctctttcaaagcgcatacgatttatttctgaatcagggaattgagaaaacatcaatcagcgatatagcaaaaaaggccggagttgcaaagggaacattctatttatattttgcagacaaatacgagatacgcgaccggctgatcgcacggacagccagccgacttttccagagagcacacaaagctctggagacagccgacatccccgaattcgaagataagattatttttattgtagattacgttttaaatgccatgcagaaaaataaactgattctgagatttatctctaagaatctcagctggggcattttcagacaggctatcaccaataatatgcaggatgatgagggtgaaattcttgcatattttagtaatatccttctggatcatccgacaatcaaacttcgtgcgccggaaactatgctgtttctgatcatagaacttgcaagttctacttcatacagcacgattctggacaacgatccgatgtcgtttgaagaattgaagccatatcttaacgaaagtatccgcgcgatcatccgtaaccatattatcgaagataccgcagaaaattaaacagcaaaagtcctgtcagaatctgaatatcgaatccggattctcaacaggacttttctatatcttctttccctgccagctttacttttgacagttttcttcaaatttcaaagccttaacgcttctcatttttccgcattttcagcttcagcattgcagtaacctttttcgcatccagctccgtcacattattttctccgagtacatctgtctcaatgccctcttcacttttattgatatccagaatttctcccagatgatcattttctaccacaaactggccaactgtaccactgaatttcagcccggttaccggaattcctctgatttccatctgttcaaccgtatttgcgaaatctacgtcactgtttccccatccatcggacgacaggataactccgtctgcccgcatagcttccgcccatactgccgcacgggttccaacaagcaatttatctgtattatcatccggcgttccaacaattatgattcccatcagatccagatcttcatccgatgataccacatcaagaagaggatccctgaaatggtgtagtgatgtttcctttgtcgatggtccaattcccataatcgcacctcctactgcatagaacggataattccgtcacgatattcgtttggtgtaacgatcaccggcatatttcccatatcaatgatcgagcgaccgttttcagttcccgaaggctcttttgcaaataacgaagtatcgtacatcgcaccctgtccagcaacctgttttacgatcaaaacacgtttttttcctgggcgaaccacatcatggtactcatgtctctctgtgcagagatcgcccctaaacttcttcatctgttcccggaaaatctggataaactcgtcacaggcatggtgagctgcaagtacaccttctctttcctgtcccattccaggtttcagaacaacatcaaatgacacaatataatcatcatcccccggagtacccgcacggttcagatacagcttctctttcagattgccttcactggacccaaattcgtgtgcctgttttccgttttcatctacaccggtaaggattacataaacgccggtgagcgtatgcgtaatcccgtccccaatctttccaagtactttggtcgatatcggaatgatatccatcatcgtattggtatagcggtcatgttctcccggtcttataatctgtacatctaatttggaaagttgtggatatttcagtaaaatttcatccagtattttcttctcgatcgtcatctttccagatgctgtcactctattttctccgccttcatccacctcagtaatatggaaagctttgatcacaagccggcgcagatctatttctttctccatataatcatcctcaattctaaattgaacccaaatgcgtcctggcacatttgaggcacgtagcaccttttatctaacaggaaatttcatcaaaatatccagttaaataaaaaggacatctccggcaaaccagagctttcgccccaatcctgccggggatgtcccctttttactatttgattatactttcgctacatattcaaacggcagcggaacaacttttcctggagtatccagcttcacgagctgttccagagttgcttttacgatgcctgtctgcatctcaacgttgtgtggttcaccagcgttagctcccataggaacacgcggagcaaccgcacgtggggtaccggtctgacgaacaaccggcggaagcgcagcaataataattgtaggaattcctgcggcttcaatcgctctctgcaccagaactgcagagcggtggcaggtacctcaaccagcggtgaggataactgcgtctacgccttcctctacaaacatctttgcaatggcaggaccagtttcatgtttgaatttttcctggtttccgccaccacccatgaatccggcatgtaccggtgcacatgctttgataaatccttctttagcaagctcatggatacggtcaatcgggaacatacagttgatgtctttgtttacatcactgttgtcatatccaccgtgagataccattaattcatctgacggcattttatctgttatttttctccaggtaaagtcaccggcaaggttgaatctcttctgatccttgtggtgcacacctgctgctgtggcgagggcaattgtcatatccttcagttcttttttcaccggagcccatactggcggcggagttaccggaacaaagatttctgactgaagtcctttaacaacggtcaaactcatgtctatttcctcctgatataattacacttcatcattcttcttatgagacttcatttcttcctgacgtctctgatacgtctgcaggttactaacatatttttcattggcgtccggtccaagctgttcgacaaaactcatattccatccaacttcctgtcctaccactaatggataatccgtaatcagcattctcatcgggattttcagataacctaatcgtcccttcaaatcgattccaacacatccatcatggatctctacgattacgccttccatatagatgatcttatcgccatatttcatagtcattcaccttaatcgtatttttcttttctcttctggctcatcggcagtgactgctcgttcttaaccaattcaattgttctgtccatagtctttgaaatcagttcgatgttatttgcttttacattcggattccattttctttctgccttcttcacttcttctccagccattccagctttcaacatagcaagtgcacggattgcttcttcctggcaaagtgtgttgcaggcaagaacttcgttctcgattcctgattcagatttgttgttatctaccatgtactgcatgtatttgtttccaactacaagtgctccctgtactgcgcagaatgaaagtccaacaaccggaattcctctcataccgatctgttcgatatggcttgcgaaatcgatgtggttgttaccaaatccttctgttgtaacaaatgcgccatcaacatcaagagcttctaccatcataccaacacgttttgatacatagaatttctctgtattgatctgcgggctacctacaaagataacaccacaaaggtcaacttcttcatcatggagagtttcaagaaccagtggttctctccagtaatgtcttgacatttcttttgatgcaggtccgatacaggtaagtgcatggatacatccgtcaagtacttccagtggagatgccatgatcggtacgtttccaaggtcaacgtttggtcttgcgccaagtactccgactggttccataggaagaatcaggttgtcatgcatagcaccctgtcccatgatttcttttacgataacgactttcttcttaccaggtcttcttacctgattgaatgtctctgtatctactacaaggctttcgtcttctactttcttcagagcttcacggatttcctgtgtgatcacgtctgttgcagaatgtgcagcaagcgggccaggtctttccatgttggttccttctttgatgataacttctgtcttgatgaagatctcacctttatcaggagctcccggacgtccccacatgatattttcatccaggtatccttcggaagaaccgaattcaccaatctgaacaccattgtcgtctgttccggtaaccatcatgataacgccatcaagtactcttgttgtacctgtaccgatttcgtcttcgccctcttttgtagcgatcggctgtacgtccatgattgtattagaataagtatggtactgatccggtgtaatgatatcaatctttaactgatgaaccagttcctgtgaagcaactgcttcttcttcaattccttctcggatgtaaagagttgttccttcgatctttgtctccggtccacgctttacttctgtaattttataatgctttctggtaacgcttcttacgactttcggttccagctcttttgtcggtgttgcgcctgaaaccacgcctgccggtaattctacctctgccggtacttccgctactgcaacaccgttattaaaacccatcggcatttcgatatcgatatctttgccttctccaatgtggatttttaacacgccgccaactttctgtacacttgctgtaggatttgcagtaactgctggtgcttcttctttcacttcttcttttgcttcttcagccggtgcttcctctgctacaggtgcttttgcgccttcaacaagatcagctgtaagtggtgtaagagaatcgcaggtcttaacaagctttgctccaagtacctgttcgattgtaagtgttccatcaagtttcagaagtcctgaatctaccagatcatcaaagatagccggatcttcaaggtttgcagcctggattgtaatgccgccttctgctctacagcataatactgcaggatcttttgcatgttcttttgcggtttccgctgtaattgacataataatttcctccttgttaatttaacaataactcaattaactatttatacactcaccgaagtgaggtatcaacttatctatttaccttccggtaactgttctacctgttttgaaacacgcagatatctgtaaagtggatgtccgattgtacgcattacatggtctgtctggtggaataccttaagtcccatcttcggtgctgatcccattactgtatttgaacagtctgagcagttaccaataataatgtactcgcatccatccttcttgaactggatattattcttagcctgtccaggacagtttccaggtctttcgcatttaagcggagctcccggtttgttttcaattgcctgtttacatctggctactgatttcactacaccattcatcttctgacaaatatctctcatacgttcttcgctaccaccgcaggcacataccaaaagacctacacttgcaccatgaagatccgggaaatcaattgtaacaatgattccaccagttgtctttgtgatcggtgcatcctctgtagtagcatgtccggtaaatggaccacccatgatgatttccccatatacaccatcaataccgccggcacgttcaatcatttccccaacgcttgtgccgaccggtacatccataaatacatgtggctcattaccgccattgatcttaccgataacagtaaggttcttagaaaagcatggctttctctcttcaattgcttccgcaactcttgcaagagtttctacattacagacaattgcattcgctgctgacggaagctgtgttgtattcagttcgattccaagacattctcttacaaccgcacgttcttctcccatcggataaatatccggaagtaagtggatcgtgatcgcctcttcatcttttaatgcctcgcgcagtgcctttactgctttttcatttttcttcttaattgcaaaaatagcttttgatgcattggaaatctccatgcagtgttttactccgcggataactttcgcacagtcatcttccagctgctgaatgttatgacgaagtccaggctcacactccgctgcatttacaaggatatatcctccctgcagatctgttccgagttttacacctgtcgggaatccggcgccacccattccgacaacacctgccgcttttaccatatcaagcttgctgccttccggaatctttacatattcatccttctgttcttcatccggcttgatgatgatacggtcttccagtacgtcttctaccacaccatatgcacttgaaaaaatattagctccaaggcctgtcggtgttgcaatcagagtccctttttctactctgtctccggcttttacaaccggtgcacaaggagctcctacatgctgacgcagcaaaatctgtaagtttgccatgtctcttctcttcctttctcctctacgtcgaaatctatatcttatcttgtcctacgcgtatttgactatagtttaacaaatagatatatttttttcaatagcatttatagattttcacttttcatgttggactcaatactagaatctagtctagtgattgatctgtactatagtctatatgattttacttgaaaattcaatatcttttttatatataatctatttatttttttcatcggttctgtctgatttttacagattgtctatttttcctcattttacttatccgcattatctataagtattctggccaagaggatttacgtcaaaaaagaaaagccaccgtactgtttcccctaaaacaatacagcagcttttctctttatctttttaaggcttttcgcccaaaaacctctctttttggcgagggcatgtgggaatcgaacccacccaggacgctcctaacgccccacactggttttgaagaccaggagacacaccagttatccatctacccccatatattgattattccaatcaagcttattcattatagcaaattaccattgacttttcaagtgttttcgtacataatatttttaaagaaaactgaactgcatactagactctggtctggtctttcaactaaggaggaatattaaaaatggaaatcaatccaaaactgaatcttgacgcatttgaggcatctttccatgcgatcgacacacatacagttggggaatttacaagaattattacatcaggtttcccgaagcttgaaggggataccatgatcgaacgtaagaactttcttgcaaagcattacgacaaataccgtcaggctctgatgtttgagccacgtggacatcatgatatgtttggtgctcttctgacagatccgatccacccggaagctgattttggtgtgatcttcatggacactggagaatatctgaatatgtgcggtcacggaacaatcggttcggttacagcaatcatcgaaacaggacttgttcctgccgtagaaccttatacagaagttgttctggatgctcctgcaggaattatccgtaccaaagcagaagtcaaaaatggaaaggtacttaatgtaacacttactaatgtaccggctttcctttacaaagaaaacctcaccacagaagttgatggcagagaagttcactatgatatttctttcggcggaagcttcttcgcgcttgttgatatcgaacagttcggatggcacgtagatccacagtcaatcccacagcttaccgatttcggtatgaagctgattgaaaaggtcaatgctgaagtagagatccggcatccggaacttgatatcacaactgtcgaccttgcagagctttattgctctaccgatactcctggatgtgacaaacgtaatgtcgttatcttcggagatcatatggctgaccgttctccttgcggaaccggaaccagcgcaaagctcgccaccctttacaaaaaaggtgaaatcaaagttggacagcctttcgtatatgaaagctttatcggctctcagttcaaaggcgtaatcttagatactacaaaggttgccgactatgatgccgttattccgcagattaccggaagtgcttatctgacaggggaagctacttatgtgatcgatccagatgatccgttaaaatatggcttcaaagtaggccgttaagtcaaaatctttcaggagacagagctatatatatggctttgtctcctttttttgtaaacaaattactttcttgttatttcatgtccattctgctataataaaaaaagattactattttcaaaggaggggaattttcatgccaaagaaaagaagttccaccaaaagccgtatcataaaagccgcgtggaatctattctacaagcatggttatgaacagaccactgttgatgagatcatttcggcttctaagagctcaaaaggaaccttttaccactattttaagggaaaagaagctcttctcaacacactttcttatctgtttgacgaaaagtatgaagagcttgcaggaatcgtagatccggatctttctgcttatgacaagctgttattttttaaccatgaactatttcatatgattgagaccagtgtcgatgtcgggcttttagcctccctctactcgtcccaactgatcacaaaagataagcgctcccttcttgaaaacgatcgttactatttcgtgtggctcactgagacaatcagcactgcactgaaaaatggagaattcaacgacaccagtactaccgatgaacttctgaagatttatgcaatgtacgaacgtgctgttctttatgactgggcattatgcaaaggcaagtattctctcaccgcatacagtgacaagcttctcccacatgtacttgaccagtttgtagaaggtttttaattctgtcattttttcattgacagtatagacacccttctgcacatggatcatcgcactacaatcgagtaggctgactcctactcgcttcttatactttgtacatcatctcgcttaacagctcgatgatgtacattcgtcaaatgcagatccttgtgcaaacacaaatctgcacttgactcatcgtatacacaaaaagaccagaacccgccccactaccagggcattctggtctttttcttttcactgccgcacttttcccttaagcactgcactctattcttcaatcaggaagctttcctgttcgattccctttccggtttcaagaagcttttcttttaactcctctaaaagtggaacatttaccttttccagcttttccatcgtctctttcgagattgttttcgcatattcttcgtatttctcgtaggtctccacatccatctgcaatggctttattcccgggaaaatatgcttctggatatattcaaaaatccggattccaccgtaatccatatctccgctgtggaatacttccacgtcttttccttcgatcactctctgcagcttcttcagaaattctctttcaagtggtgaaaaatatccatgactgtagatataaaggatctccggatcatattccatcgcaaggtaattcgtcttattctcgatcgtcacgatttttttcagtgccggctgctctacctcaaccattgcatgcttgactgtctggctgttcagcacaactccatatgtaaaatcggaaagatccactctttttgcttctgatcctttccagatcttcagtttaagcggtcctttaactgccagttcctgggaattttcttcgatcagcagctgctccagaaccgtctggatatccatatctgccgtaatctccgggcaatatctccttgcagccgtcaccacatttcgttccatctcccgctcgaagatcttgctgtccttcagatagcgtttactgaaaatccgcttcatcatcggttcttccagagagtccagtccccggtaacagtccagatatttttccagcttctctatatttttcggcagatcaccttctgcgatccgctctttcagcttttccagataattctcgatccattctttctgaaagccttccgaaagctcctggtcaatcatacgtatataataatttaccttcgcctgcttcggccagtattcttctccactttcgctgtctgcaagacggtaaaaatccggaagatgctctacctgatatgctacaagctctacatcactgtctgggacaacccattttttcacagtcagaagtcctgctctttccagacgctgcacctcttcgatcagctcttctttcccacaggcatcataatcctcctgtgtgatccgaagagtcctccctccagtcactccttcccgccagtctcggctgctgttctcacatctttctataatcctgtctaccagatacattttctatcacccctgttcttcctcatccgcaagctgtgcgaactcggttttttcaaattcctgaattgatatatgccgtttattcgggttggcatatacaaaggttttatcaacattttccagataattctggatcttatcatttgtggcactgatgatcgcctggaaaccaagtccacggatcagcgcaatacagcttgccaccttctcggcatccatttttgaaaatgcctcatccagaacgaccagtctgagtgtcggattcctgtggattttcggggaaagattgatcctgtaaatctgtgcaaagcttgcaagaagtgcaacataaagaggattttgtccttctcctccggaattcttgcggatcatcttgccaagaccgattttcatatcttcctcaccctggacgatctgctgcatatcaaacgaaagataagtacggtaatccgcgtacttgtccatatttttctttgcctcttccagttcctcatgggtagcattttccggtgggataaatatgcctatcagttcattcatcatatcaccgtagttttcttcatgctccatcgtgaacagattcatctggttctcaatagaacctgaaagctgtgccggattgatctgcagggtatcatccataaacatcttatagtactttccgtctgcacccttattcttcgtgatcacaaactggtacttatcttttccgaaatccagccggctgatgatccggttcagctcatctcttctctggtaggcctcgcggatcgcactgcggatcttgaaaacaaagtcatccttgaagtgctcgaccgctgcctttgcctgttcattcgctgcctgccggtaggtttccagattatcacacgacaggctttccagaagctcctgataaaccttattatcttcttctaccactgagaaattacgctgcgtatattttttggtataagcactgcgggctgccaccaactcctgatagatctcttcttttttctttccaagctgctgcagctgccttgcacttgcctcttttaaataaatatagtttctgtttttctgtgcttccagatactcttcaaactgcttttcaaacctttcgttttcctgaaattctttctggattccagaaagtgcaaattccgactctgtaatactgtttctgaatttttcgatttcttccccgtttttccagatttctttctctgtcttcgtgatctctttctgctttgcatcccgtctttcctgcacttctttcatctgtgcttccagagtatcgactgattctgcacgcagtttctgcagcttttcaagtaaatctttcttacgggtttcttttccctttatcgcctttgcatccaggatctggctgatataatcctctgtcggaagtggcattgcttccagttccagaagtttctttgcctcttccacaagtgccgcaagtggaagcctcttctcctgaagctcatcacagtgcttctgaagctgccggatcctctgacggagactaatctctccgatataagcacgtctcgtataattttccggattaatatgctgcagacgatagctttgatacagcatacagtccggtgtcacaccaatcctgcactccctgagttcctcaatgttctcacatttcataacattaccaagaaagaaattgatgtaagactgcacgtatttttcttttgcttttacttcttctgcaagagcgccctgccggacaatgtgctcttcttccataaccttttccgtatccagaattgcagcacgaaagaatttcttcttatccatctcctgataaatatccattgccgcttttgcgtatttcggctctacgatcagcagaagtttattatttcccatataaccttccactgcattgtgccatctttcatcccggatttccagaagatctgcgaggatctgcacggaaacaaattttccacaattctcctgcaaccggttctgtagttccagccttgcttcttccagctcttttggatatgcttttcttccctgtttcagctcttttagctcttctttggcttcccgttcttctttcttgatctgacgaagtgtactgtccgtatcccgacgttcttcttcgatctccgcacgcatctgtgcgatattttctttcagccttgtaagttcgccctccgaaatcgtaccggcttcaaatttatcaatatcccagatggtctggttggacgtaatctcctgttctttccatgctgcaagtctctgtgctgtctttgtgagactcgccctgctttttcccagatgttccagagtctcgttaagtcctgcaagttctgcttccagtgctttataaccactgttattcagacgaagtaacagctcctcatgctccttttgcagttctccactctggcgcatcagctcggctttcgtatgctcctgtaccttgataccttcttctctggttttaatcttatcatggagtccctggatgtccgcctgcagccggagcatttccagacgggtaagacggtagtcacattccctgcttttttctcgcttatcatcaaaatcctgatagattccatcgatcttcttcagttcctcaatctcttccatcgttgactcaattttgctgcgcattctgccatactgcatgatactttctttcagatcctcaatctggatatcctgttccatacagatatattcttttacaaattcttccagcttgatattcatccgaaacgggattgcccgcttaaaaagacgtgggaacttttctttatccaatccgcccagatacacatcataaagctgacggcggaaacgctcattgctcggtccgcagtagaatgcctcttcaccaaaggtacgctgcagatattctcttatttccacagtagaaagacatctcttttctccccggtaagcattcgcaagcagaccgcttctgtgccagaaaaacaggcggttgatctcatttgttgctgtctccacgtcaaatacaacgcccacgcactgtttctcatgggttctcgtctgttccagctcgattacgatcgtactggaaaaattcttatttcgcagatactgggactcattattttcactgatgtttaccattccgcgcaaatactcgatcaaggtacggtcggaatcatctgctgccgctttattaaaaaatccacgtccgtccgtgttagcatagagtacaatctgaattgcatcgataaccgttgattttccacttccggaatgcccggtgaaaaaattgattccttcactcaaagtcagtatttttctgtctatataatgccagttgttcaggcagatttttgaaatcgcccagaacggctgcctgttatccaatgtttccaagagtctcctcctcttcttcccggctgcttccaaatgattccagaacttctctcaccgcatctccctgcaatactgcatggatacacggatagatcagaagtcttgtactttcatttaactcttccagtacatccaatggctcgatcatctggtattttttcagcatggcaatagttcttttcatctcggtcggtgacgggatactgcgaagcacgcgaaaatctcctgcttttccgttgagtgcccccaaggttgtcacaatctggctgctcgacgaaaccgatgccatctgctcatcatagatcagcttcagcaataatatgtaaatagtcgcaagacgcggaagcttttctccccagaccatctcatcctgaatatagatcagacccagatgtacattctcgcataatgtaatgccggcaatctggaaatacattttcagaaaatcaatgtgcttttcgcagatacggtactctctctgatactggagtctgcccgcacgcttgtcaaacttcctctccagaagaaatgtctgtctatagagaagcctgatcacatctgtcagatcttcctgttcttcctgcgtaagctgctcaaaatattctatcattcattctctccaattttgtcttctttttctataaatgtcttcttacaaacttcagtgcaggataacggtatccgttcttttcaatcgtctccgcatcctcttccagcgttttatatttgctgttcttacgggtacttaagtcatatgccagaatcagcttttcaaaatcctcctctgatgtaagggaaagtttttctgtatccagcacatctttctctatatgctcttcgataaattcttcaatctgctttttgctgaatctgcgcttgatccggttcaatctgagcacatcttccctgtccagatcatccacttcttcttccggtgccatctgacttacaaaatccttccggttttttcttcgcttataaagagatttttctgacaggatttcgaccaaagacagattcatcttctcccccgtcttttgaatgacctcttcatagtcatcctctgacatccggttcaggagctgaataaccagtcccttcgtgtcgctctctccgctcagaagataattcagtcttgtcaccgtcgcacgcacatatttgctgtgctccttatccatattggaaatgcggtgctcgatatcatcaaagcctctctcaatcatatccagaagttccagcacatcttctcccgtatctccggttgcacgggcgcgctcacggatcttctcgatccattcctcatcatcccgcatctgacacaggcattctttgatatctgtcttatagatataaaaattatccgaagtcttcaggatatggtattttttccggacaatctcttccacatatccgtccagatgctctttcagaagatccccgtaaaactgctgttccagaagccttgcaaaaaatttatccatgttatgcagcatatcctgcagtgctttgttgagccgtctggtattgataagtgctgtccggagcatattcagattcaccctcggatcatttttaaacgagaacaatgtcgcatagacattctggatatagatctctgtctcctccaggtcctccgtagaaagccgctcaaaggcatccacaaatattgctgcataatccggaattacgatattcgtcaccaatgtattataatcttcaattttcttcagccatccttttcggatcagccagttcagaatccttgccgacggagtctccaacatatcaaactcagtctcatcttcttctcgtttaagttcgatctgtttcttcatatacagatcccgaagcacctgaatacagacttccctagtcaggaaataattgctgtactggtattcttcattgatcgccatcaaagcctcaatgtatgtctctctgttcacagaacgaaacagactccagaaagcctccggaatttcaaaacgtaactgcatgccttgcctttctgtaaattcataaatttttccattatctataagtataccatattctagtctctaaatggaaaaaacattgcaaaaaggcattacgaaaaagtgctgcaaaaccgatcactctcatcggcttgcagcacttcttcataacgagaccaaatatctggcagaatatttgattattattttaattaagcaagtatgggttccatatttttcagtatgactatttgataaatccaacctgtttgctgattatctcatactgttcgtcttttctcttattgtagattacttttctttcttcaaagaggttgtttccttctgtatcgatggatacaatcagtggtccaaactcttttacgcggcagttccagagcgtttccggcattccgagatctctccactcagctcttacgatctcttcaacctctgttgctgctactacggcattaccagccgggaatacgcagtggattgctccgaactctttacatgcacgttcggtgttttctttcattccaccttttccgatgatcacacgtacaccagatttctgtacgaattcatactcgaatttttccatacgcatactggttgtcggtcctacggaaaccatctcgaatttgtcattttccaatggacggatgatcggtcctgcatggaaaattgcgttgtttcttacatctacaggaagttctcttccttcttctaccagacggcgatgagcaacatcacggcatgttgtcatacttccgttcaggtaaatgatgtctccaattttaatgtcttttaagtcctctgctgaaattggtgttgttaaaattttctttccgtcttttacttctaccattataattccacccccgaatgtgttgtgattgtgtaattaaggtccttgtcaaatacaatgtgtcctcttctgtgactccaacatcctacgtttacggccacaccgattgcagatggatgacgtgctgtattttcgatgttaacacccattactgagtattttccgcccattccctgtggtccaaggccgattgcgttgattccgtcttccagaaggttttccatctttgcagctctttcgttatcattgtgagagccgatcggacgcatcagagctttcttggaaagcagagctgctgtttctacagaagttgctacacctacacctacaagaagcggaggacatgcattcagtccgtagcttgtcataacatcgagaacgaattttgttacaccttcgtatccttcacctggcatcagaaccatagcttttcccggaagtgtacatccgccacctgccatgtatgtgtagatttcacatttgtcagagtttggaacgatatcccagaatacggtcggtgttccttttcctacgttctttcctgtgttatattcgtcgaatgtctcaacgctgttgtggcgaagcggtgcttcgaatgtagcctttactactgcttctttcagtaatgcttccagatcatcgatcagtgggaattttgttccacattttacccagaactgaaggacacctgtatcctggcagcttggtctgttaagagctactgcgagttcctggttacggaacatggtatcgtagattaccttagacagcgggctgtcctctttctctctgagttcctgaagttttgcgatgacatcatctggaagttttttggcaacgtgtgcaatgaactttgccatgtaatctgtaagctgtgttacctgttcttctctagacattttaaaatcctcctctttttatattgcatttaatttaattactttgttatcccttcttacgggaagaatggatagaatatcggaagtaagatcatacttactacggtggataccagaatcagcggcacacctgcttttgcataatctttaaatgtatatcctccggctgtgacaaccattgtgtttgccggcattccgatcggtgttgcgtatgcgcatgatcctccgatgacacatgccataagtgctgttgttgctgtattcgacataaagttggtaagtacacagcacagcatgaaaattacaaatgtaagtacataaggtgacgggttctttccaagaagtccgattactttgtcagcaatcaactctcctgcccctgtctgatcaagtgctgctgcaagggaaagtgttccaccgaacaggaagatcgtcttcagatcgatggaaagaagtgcatctttctcactgataactcctgtaaggatcagggcaattgctccgacgcaacccgttacacaaagcttgattccgatctgttcttcaaagatcattccgagaagtgtaagaatcagaataaccagggaaagtgtctgtttccactttggtacattgcagaaatcctgtacctcatcataaatgctgtctccagctgcatctgtcttgttcggaagaaatttgtatccgatcagtgcgaaataaatgattccgacgatcaggatcggtacacctacttttgcataatcgaagaatccaaatttcagtccgatgctttccatctgtgactgtgcgatcatgttacccggagctccgatcagagaaaggttacctcccatcgctgctgcgaatacaagtggcatcagaagtcttgatcttgaatatcccgactttgctgcgataccgataactaccgggatcagaattgcggctgttcctgtgttggaaaggaaaccgctcatcacgcctacgatgagcataatcgcaacgatcagctgcttctctgtcttggcgaaatgtgttacaactccacctattttgtttgccattcctgtttcaaaaagtgcgccacctacaatgaacatcgcaacaaacaggatgacgttgctgtcaatgaatcctgaaaatgccgtcttccagtccagaactcccgtgactaccagtcccacacagacaatcatggatgtcagtcctaacggaattttttcccacatgaacatcacgattgcaaacagcaggaacaataatgtgatagttacctgactcattttgctacctcctcatttctctttttattttcttttctggatgtcttttacttgatatctgatttttgatatctgattttgtatccaaatattgattttaatataattcattgacaccaaaatgtcaattactttttatcattttggcggatagcataattctgcatattctattttgtatattctgactaagattcttctgtcatattgcacgaaatgaaattttttgcaaataaaaaagacttcaagaagtatctatactctcaaaatctttttatgttctgtgtatatcttttattttcttacacttatctacttgtaatacgtcagcatatcatcgcggcttcgcatgatatgcgcatacatctctttttctgccgcttcgacattatgctcctggagtgctttcagaatccttccatgctctttgatcgataccttcacataatcaccttctgaaaccatacttcccatagaaagtccgttccaaagttcggagatcatttttttcatctttccattacctgccgcactccagatttcattgtgaaatgcacggttgagatccgtgtatttctgggattccccgttttccagtgcctcacaagattcctgatagacatcttctatttccgcaatatctgttcccggttctgctgcaagctttgctgccgcactctcgaggatcgcgcggagctgataatgttcccggatataggtttccgtgattccaaggacgactgcccctttattcttccgaagctggatcagcccgtcccttgccagaatctgaaatgcttctcttaccggcattgccgacacatttagctgagatgccacactgtcgagtgaaaggatctctccctctttcatttgccttgataaaattgcttttctaagctccgcagcaactttttccttcgctgacggcatcttgatcggttttaaaccattcatctattcttccttctttcttccttcacctgctctgccagaagcaatacccatctgtcaatctcactattgaccgcttttgcaaatgtttttgtatatttttccgcaccatttaatgcacctgctatcttttcgcagattgccttttctgtctctttttttccatccgtctctttacattttgtggcaaaccggatataacactccgaagcatttttcagcagattcgtcagatatccattctccatctgtgcaagaagcaactggtccggtcttgtttccgtcgaaaatacttccttttcctctgtttgacttttcgtatttagaacatgctgaaccgcttttttgaggatttccccgatcatctcaaaaatcagttctatctgctcttcatccagctcaaccgtataaattctttttgttgccagcctcacgatcagcccctgactctccagaacctgaaatgcttcacggatcgggattctggatgctccaaatacctcagcaagctcttcctgctttaactggcttcctccttctatcctgcccgccagaatttcatccgcaatctgttctgccatataatcgctcaaccgcttttctgataatcctttcatcttcccctccaccataccgcagttaattagtaggatatactaataatgtatccaaaatcagtctaaatgtaaagaattatttttcttgttccacgaatattctcagtaaatgattttagaaatatgttttcagaatttcctgttaaataaaacaaaaaaggaaaccgcaaaaatgattcctcatcttgcggtttcctcgttttacctcttcttataccatacactcgtggatctcttcttcttcaagaccgattccctgcatgacatttttcagttcttccctgcattccagtggtgcgcaccaggaaagcccgcatcctgctgaaatacttctcggcaccggaatcatacgtccctgtgcaccaacttttttacattctttttccatcgccatcgcatccgctgttgtatggaatgtgataaccagctttaactctttttttctcattattcaatcacaatttcaaattcagagcccttctcggtagaagttgccttctttcctttgtccttcgcaaacttctcgatattagtcttctggtgaggttcactcacaagaaccttgatcggtccgtttgcattcttcagtgcctctgcggtaagcatcagcggttccggacacgaaagtcctcttgcatctacttctttcatattttttacctgccttcctagcatatcatatttcttatggattatccatctatatcttgcggtttctgactattttgtctgctctcttttgtttgtaaatgcaatgataaagcatgcgataatacagataatgcaagcaacttttccattcggcgttacggctcctgcaacgagttcgccggtctctgcattcatagctgttccgcttgatgcaagtccgaagttatggcaaagtgctgctgcaaagaacatgccaagtacagtaactgctgaatcagaagaaccctgtcctgcaaggatcagctggcgaagcgggcatccgccggcaagaactgccgcgaatcctactgcatacatgccaaggatattccacagatggttggaatgtgcaatgattccaggagtgttaaatccaagtacaaatcttcctgttgccagattgaagatcagcattactacaaaaagacctgcaataattgtaagaagatcaaagttcttcattaagatcgcatcacggattccgccggcaaagcacattcttgatttctgagcaagtgctccgaaaataagtccgccgatcagtgacatgataattggtgcatgaagacttccaggacctgcttcacttgctttgagaagtgttgagcaggttgcaaggatcagaataccaagcatcagtaccggaagcactgctccactttctttgtttgtctcatgcgcacgtccaaggctgaaaccatttttgagtgcaaatgctccggttccaactccaagtacaaaaccgatcaatgctacccatgcattcaggtcacctgctgacatacggatcaccatacggagcgggcagccaaggaaaatcagggaaccgatcataattaccataccaaggataaagcggatcatcggtgaagatcctgctgttgaacggtattcttttgttgccactgaaataataaatgctccgatcacaagaccgatgatctccggtcttgcatactgtacaacttcggcctggtgaaatcccagagctcctgccgtatcacggataaagcaggcaatacagaatgccatgtttgccggattaccaaagtaagccagacatgcagctacaagcccacacagagcccccgcaattgcaagcttcttctttgaatctgataaattcatttttcttcctccttcgtctttctctcattcgtcattttgactattaaagacttttttgttaccttataattatatcttttgcacaacttcttgtccaattcataattaaaatagaccgatatatatattgatactatcaatattataccggtcttctatcaatctctgatcttataaaattttactcttcttctgcaagctcgcagattgcccggattgccgtatccacttcttcctctgtgttatagtgggaaaaactgaatctgacagctccctgctctacagttccaagtgcctcatgcatcagtggtgcacagtgtcctcctgaacgggtagaaatcccataatctgtcagaagtgcatcgctgacttctcccgagtcataatctctgatattcaggctcactaccgcacagcggtccatgctgctgaaatccccatagattttgactcccgggatttcttttatcccttcataaaaccgcttcatcaatgcctgttcctttgcgctgatcgtatcaattcctgtttcttccagatatccgatcgcagcatccagtccggcaattccgtgtccgttaagtgttcctgcttccagtgctgtcggcatctcttccggctgtgttttactataggtctgcacaccggtaccgcctgaaagaagtggccggacatgaacgccttttctcacatacattccaccagtcccctgcggtcctaaaagtcccttatgtccggtaaaacacagaatatcaatatgcatcttctgcacatcgatcggaaatacaccggcagtctgtgatgcatctaccacaaacaacagatcgtgtttttttgcaatttccccgatccgctccacatccactttgtttcccgtcagattggaaccatgggtacagacaattgcttttgtattctctttgattgctttatcaaaatctgcgtaatccagagttcctttttcatcacatccaaggaatgtcacttcaactccctttttctccatctcataaagtggtcggagaacagagttatgttccaaaaccgtagagatcacatggtctcccggatttaagatccccttgattgcaatattcagactctccgttgaattcatggtaaatacgatctgtcttgcatcttccgccccgaaaaaacctgcaagcttctctcttgtgtcatatacggttcttgctgctccgagagatgcctcgttgacacctcttccggcattccccattgagcacattactgcggtgatcgcatcaattacttcctgtggtttgcgcattgtggttgctgcattatctaaatatatcatattgatcctcttttcatttccccatatgtgcatccggataaaaatcctttacaatccggatcagatgctctgctgctgcaggcagctgatagtttttattgtatacaaggttcagataacgactgctttcatccttctgtaacgggaattccagaacctgtccggtccggatctcctcttctgctgcaagtcttgatatgatcgtgattccaagcccactctttactgacctttttatcgcttccggattctcaatgcatgctactatattgagggtatcaggcataattcctgcttttctcaatattttttctgtttccttgcgggttcccgatccttcttcccgcgtaatgaccggttcattctttatccatgttgctgtcttatagcgcttctgtatttcctgataaaactcggtattcggcatgataacaaccagttcatcctgataaaaaggcatatatctgcaatgctttttttcaagtaccgtacctgtaaatccaatatctaccatatgccctgctacctgttcaacaacaccgcagctgtcattttctgaaatccggaactgctcatccggataagtctctctgaatttcgccagaatcgccggaagaacatactgtgccggaatcgtagaggtcgcaattgtaatacatttttcctcacgatgcgcatccttggaaaatacctgctcgatttctttttcgagttccaccatctggcgcgcatactggtataattgctttccttcttccgacaattttacttcctttgtatttctgacaaaaagccgtgagtccagttctttctccagagaagagatatgtgcactgaccgttggctgcgtcaggaacaaaagctttgccgcttttgaaaaacttcccgactcagttaccttaacaaatgcctccagctgctttaaattcataagtatgccaccctctcactttctccgcctgtcttctttgtcaccttaatgctgtccatatattctaaaatcggtttcgcactctttctgcttgttgagaacatatctctcacctgtgcgatcgtgatcagattttcttccttcagatgattctgaattttttccttcgcttcatccatcaggtgtttcatcgtaaacatctcttcattgatacggagtacttttccttcgtcaatcatcatgagaaccacatcttccgctgtctggcgcggaatttttccaaaatcaatctctgaaaatctcacaaaatcatatcctgctttttcaaatgtatcttcgatcagcttctctgtctgaagatacatcgcatccttcggaacttcatatcccggaagcgaaagatattcttcccttcttccatagacgttttctcccgtcattctttcgatatacgcatcaaatatgtttggtttgatctttttcaggaatgtattgtgaatttcggctttcttcattccatatcggtatggatgctcactgtgatatttctgcaatgtctcctctatcttctgacgtactgcaaattcgctgtctctgtgccacaaatatgtatccttcttcattgggaatacaaagattgtgcccgattcttccagttcttcaagatactccttcagttcatctacggaatgtgccatcacctttgcaagctcagcaagtgtgatcatcgtgtcgccgtgttctttgatctgaagctccataacatcgccaagtgaaccggattcttttttcttcagttcttcgattgcctgtgcatcaaaacgtttcttacgcaccggattcggttccagcacgatcccgcctccgatagtctccatcggagaatagaaacgtactacaaaacggtcgcctcgtttgaccgcaatctcttcttccagtctgagctgtaccagtccctcttctcccggtccgatctgctccttatccagcagaacagcacggcagaggatctcactcgtacccgtatataaatgcaatctctcatgatttgtaaggatacgcatggagtcttccagaactttcagcttcacatccagaagatctgtatttttcatactgttcttcggcgcaagcacacaccctctgcgaatctcctttttcttcacatttgacagattgatcgccactctctgtccggcatagcatttgtcctgattctgcccatgtacctgaatattacggatcttgcactcttttccgatcggatacatttccagaacgtcttccctagtgatcgtaccggagataagtgtccctgtgataattgtcccaaagcctgacagggtaaatgcccggtcaatcggaagtcttggaatagtctgtgtatcctttgcaaccacctcatccgacatcagttgctggatcgtatccgtcagttcatcaagcccctgcccggttgcagccgatactttaacaaccggtgcaccttccaaaaaagtaccttccagttcttcctggatttcttcctcaacgagttccagccattcttcatcgaccagatcacacttgttgatcaccagaatgctcttcttgatcccaaggagtcccagaatgtccatgtgttctcttgtctgcggcatgataccttcatccgctgccacaaccaaaagtaccagatccattccgacaactccagcaaccatgttgttgataaatttttcatgtcccggaacatcaatgatccctacacggtctccatttttcagatcaaaataagtaaacccgaggtcaatggtgatccctcttctctgttcttcttcccaccggtccgtgttacgtccggtaagtgcttttatcagtgtcgttttcccatggtcaatgtgacctgcggttcctacgataatgtttttcataataattctcccagcatctctgctatcttcttaaagtagcaggattcaattgtccgcacatccagataaatcgtgtcgttggctgtacgcggaatgattggcatagaaagatgccgcatctcttcttccagcttcggtacactgatattctccggcttaatcgtaactgccatactcggaatgcgttcaagtggaagagagcctccaccgatctgtgattcacacggttccatcccgatcgttgcagcaagatgtgcattctgcagaatccgcttcagagatcttgcacgcttttccacatccgctttggactctgtgatcatacgcagtaccggaagattctggattgccttttcttctgataaatattcctgtaataccagttccagtgctgctgctgtaaatttatcaattcgcagtgcacgtgtcagctgattcttcttcatctggtcaatatattttttcttaccgatgatgattccagcctgcggaccaccgagcagcttgtctccgctgaagcatacaacgtccgctcccttgcggatggaatcctgaaccgtcggttcataggtcagtccgtatttactcaggtcgatcagcacgccacttccaagatcttcgatgatcgggatatcgtgttcctgcgcaatcggaatcagttcatcgatcgtaaccgtctctgtaaatccaacaatacggtaattgcttgtatgaactttaaggagtgcttttgtctcctctgtgatcgcttcttcataatcagaataatgtgtcttattcgtcgttccgacttccacaagtgaagctccgctctgctccattacatccggaatccggaatttgccaccgatctcaaccagctctccgcgggatactacaacttccccgccttttgccattgaacttaagatcagcataacagccgcagcattgttgttaaccgccatcgcagcctctgccccggtcagtttgcaaagcagtttttcaaaatgagagtatctctctccacgtgctcctgcttccagattgtattccagattggagtaaccactcacaattcctgccagtctctcaacatgctccttactgatcggtgcacggccgagattggtgtggagaactgttcctgttccgttgatcaccattttcatattcggctcatgcagctttccggcatgccgttttatattctgcgtaagcatcccgatctgcgctttcgctttctcttcttcctcgcactttccgataaatgttctgagcgcatccatctcttcacggatcacatccatcacaagttcacgtccatatgcatcaatcaaatcctgtatctcctgttcttcaagcagaatatctactttcggaatactgcgaaataataaatttttattcattttctcctctacctctttgaattcctagtgcagacgaatcagtttatcgctcttttctgttacggttccgatcagggataccttggtatccagtctcttcttctcgaatgcttccatcacggcttccgcatactgcgcttccacgctgatgagcagtccacctgatgtctgcggatcatataacagatcgataaaatgatcttctacatttctgaaatctactttctgataagaatatcccttgttcttgtaagcccccgccggaacaaggcccatttttgcatagctgattgcttcatcaagatatgcaatatcgtgaacattcagttcaaatgtcacattacttgcctctgccatttcaacgcagtgacctaaaagaccaaatcctgtaatatctgtacatgcatttacagggaaatgctccacaacttcttttgcttttttatttaaagaagacatgacaatctcagcttccctgattgcggctgcagatgccatttctcctttgattgctgtattaacaattcctgttccgatctgtttggtaaggatcagcacatcccccggtttacatccgtaattcttaaaaatcttctttggatgtacaaatccggacacacaaagtccgtacttcggctcatcatcctgtactgtatgtccaccaaccagaacagctcctgcctcttttaccttatcggctccaccggcaagaatatctcctaagatctgtggatcaagacaattcggaaatcctacgatattaagtgctaccttcggctctcctcccattgcgtaaacatcactgagcgagtttgctgctgcaatctggccaaacatatacggatcatccacgatcggcgtaaaaaaatccacggtctggatcatcgcaatatcatctgtaaccttataaatcgcagcatcatctgatgtctcgattccgacgatcaaattttcatcttcaaatttcggtaacttacccagaacctgggcaagggtctccggacctactttagcggctcacccggaagtttttgcatactgtgtcagtcttactttttctttattcattgtttatccccaacttatactttgcatttaacatgttacctgccgcaaaaaatgcacacatagatgaattctatcattcatactttctattgtaaagactgcttttgcaattcatacttttctatgatcaattctctcacatgttcagccgctgccggaagtttgtaattcttattatatacaagattcaggtttcgaccgctgccatcctgtgaaaacgggaattccagaacttctcctgcctggatctcatctgcggccgcaagtcttgaaataattgtaatgccaagaccacttttgacagatctcttgatcgcttccggattctcaattgtcgcaacaatattcagatcctccaaagagattccaatcttttttaattgcttctctgcttcttttctggtaccggatccctcctcacgcataatcagaggttctccttccagccattttaaatccttctgctcttttatgattttctgatattctttcgtattcggcataataacaaccagatcatcctggtaaaacggtatgtatttacaatttgctttttcgattactgtaccggaaaatccaatatcaaccagatgcgatgctacctgttcaatgacagtactgctgtcactttccacgattctgaactgttctttcggaaatctctctcggaatttcaccagaatatccggcagaatatactgcgccggtatcgtagaggttgcgatcgtaatacatctttctttctgctctgctgcttttgaaaacattgactggatttcctgttccagttcgatcatctgacgtgcatactgataaagtgtctttccgtcctcagataatttgacagtcttggtattacgcacaaacaatctcactttcagttctttttcaagtgtctgtatatgcgcacttactgttggctgtgtcagatacagttcctgtgctgcttttgaaaagctctttgaatcggatactttaataaatgcttccagctgccttaaattcataattattccctctttctattcgatcaaattcgtataaatacaccctcaccggattccgttatttcctttgatcaaattgcgcagccacatctatcttctaccatccgatatcaaataccagagagcaaagtgcatctgcccgaacaaacaaattctttttatccaggaggttaccatcttcagtttttaacaacttgtccagagcctgaacaagggtccttcgacctgctttgacgcctcaacatgatgtccttatacactgtgtctctctgatatctttattcatacttaatttctcaacttttcttaaatattctctgtccgttatacgaacttctttgttatatagttctcaaactatggtctgatgatctttcctgcttcagccatagattcaacaatactgtacatattggttacaccaccaacaacaagtttgtcttttaaatgatagtagtcaagacatgtaccacatgtaagaatctctactccctgtgcctccagagacttcagatcttcaatggaatctgatccttctgttgtaagagtagctcctccattgtagaaaagcatcttcttcggaagtgtatcaagctgtgtaactgcataaataaatcccttaatcaggactttaccaagttcatcattacctgttcccatgcggtcagaagataccactacgataaggtctcccttctgatccggtgtacatacaacttctgcatctactgccggtactccctgcatcttgatcgttactttgtattctttttctccaagcttttcagagcttacttctccgccctgttcttttgccagctttgtaacattctgtacagcaatctcattatctactaatacttcaattgtctccggtcctgtaagagcctgcattgctttttttgttttgattaccggaatcgggcagttgtctcccattgcattaactgttaccataatattcatttccacctttcttttacgtgaatcatttcacttatagatacattctatcacccttcgtcccttatgtaaacagatagtcccgttatttttaccaaaaaccatttgttatcgcgatagctttttgtatattattgcgatattttacattcgcttcttgcagtatcctttcttctataataaaatagaaaagtaaaacagtatgtctataaatatgcattgaacaagactatagaaaactggaaatttatcaaaaagcacttcagaaaggatttaataatatatgtggttagcagatggttggaaagattatgaagtaattgactcctcagacggagaaaagctggaacgctgggggcagtacatcctggttcgtccggatccgcaggtgatctgggatacacctcgcacagacaaacgctggaaacatccgaacgcacactatcaccgcagtaaaaaaggcggcggtgaatgggaattcttcgatctcccggaacagtggcaaatcagttataagaatcttacctttaacttaaaaccgtttaattttaaacataccggacttttcccggaacaggcaaccaactgggactggttctctgaaaagattcgcaatgccgggcgcccgataaaagtactgaacttattcgcctataccggtggtgcaacacttgcagcagctgctgccggcgcacacgtaactcatgtagacgcttccaagggaatggttacatgggcaaaagaaaatgctgtttcttccggactcggcgatgcaccgatccgctggctggttgatgactgtgtcaaattcgtagagcgcgaaatccgccgcggtaatcattacgatgcaatcatcatggatccaccttcctacggtcgtggaccaaagggcgagatctggaagattgaagacgcaattcatccactggtaaaactctgtacgaagattttatctgatgatccactgttcttcctgatcaattcttatacgacaggacttgccccagcagtactgacttatatgatcgcgactgagcttaagaaatacggtgggcatgtggattcacaagagattggacttccagtatcttcaaatgggctggtacttccttgtggggccagtggaagatgggaaagataagattgcggatttttgattgatacgtttgtggcttctcaataatacaacgtttttccgaatagcagaatctcaatttgtgcaatcataaaagatctaaaataaaagagaagtgatccggtatgaaatggatttctcctgctataaagcttgtgctttaaagaaaatccttttctaaactcagattacttctcttttttattttccattctcctttgggtttcccatctgaaaatttattgcagatgctccatcagatagctaagaaacgcctggcaaccttccatcacatcatcaaatgtctcatcaaaatttcctgtataccatggatctgcaatgtctctcggacgatttgtgtaatccagaagtctctgtaccttgtgctccgggtcatttccgatgattctcataatgttctgtatattatatcgctccatgcagatgatgtagtcgaatgcgacatattcttctctacacatcttgcgtgcacggtgattgccacacgggattccttccttgcggagcttcttttgtgtgccgcggtgaactgggtttccatgttcttcattgcttgtaccggcggaatcgatgaagaaatcggattctatgccggattgtttaactaaatgtttcataacgtattctgccatggtggagcggcagatattgccgtggcagataaaaagcacttttatcattgttgcataacctcgcatttcttagtttttcttggtatttcgggctttgtaagcctttgtaaatttttgctttctggcataacctggtttattttcgcataatattgtccgcaaaaggtgtaaaataaggtgtatgtttttctattttacaccttgctatttttaattaaacatcgtaattacacaacctgaatccgagcaatttcttccctggcatcctcaagatttacatgcgtatatgtattcaacgttacgctgatctctgagtggcccatcaaatattgcaatgcttttggattcattccggattttgccatatttgagcaataggtatgccggcatacatgcggtgtaatgacaggcatctgtactttataagtattattatacttctgaatgatgtgttgaaaataatgctcccagtgcagggaataacagatactttcatttttatcaaagtataagaatccactttttccatctaccataggttctgctttgggcgggttccgtttttctattattttccgaaaacattcctctacatctgcagtcataggtatctttctcgttccactggttgttttagtctcttgaatataatatccgatttttgattttttctgcaattgatgatcgatgttgatcgtatgctccttgaaatcaatatcagaaatcgttaaaccacaaaattccgagatgcgaagacctgttttaaacaatatgtagattccctcataatacctgcaaaaatgaggatcctccttcacaaatcgtagaaacttacgttcctccgctctgctgattgcctctcttgtcacactgtcattcacaatcacttccattagctgaaactgaaatggatttttcctgaccaggtcatcatccactgccaactgaaatgccggacgaaggactcctcggatcgaatggatggaactatagcttttcttttctatctgctgaagatgtatcagccaacattttgcatccgaaatccgaaccgtatcaatccttctttttccaaatggatctttcttcaataaattgataactgttccgtatccagcaactgtagtaggtctgacaccggtttttgttgatgtatatttttcaaccagttccagtaccgtcatatttccgccatttgttgcaatctgctcaaaatgatccgcctggattttcttctccatctctcgaagcgacaaagtacggcgctttcctttcggagttgcatcgttatggtctaagcgccagctatatacgcagcgctcctttcccatctcatcgacatacttaaatcgatatctgccatcagataactgtatttctccattgtgtaatatacgtcctctatgatctctccttttttcactcataatattttagtctccttcatcaaatgttcatttaacttggaagaccgtctcggtttattcattataccacaagaccttcccttcgctaagataaaatgaacattattttcattactatttcttctattctgtcacttaaactgtgctggctgtatccagataatcttcaaataattttcttttgaaccggatatgcgaaccaacttccaaaatgaaatccgctccttcatttttccctgcgatctgccttaatctcttctctccaattccataatattctgctgcttcggaaacatttaaagaatatttcttccaaacaggtattgttttttctgtatgattcatttgcattcgtcctcccctctgtttgtattcaacaacgtttttgctttctccattttcatacttgcaatcgcttctcgtttacttactcctccaacatacattggcgtacacatttctaaaatacggtcatagatacgccttttatccaacatagtctcgctttttatttctttcagcggaagattggtcgtgatgatcaatggtcgtcctgaacggattctgcgatctatgacgctaaaaataattcctaacgcatattctgaatttcgttccactccaagatcatcaataatcaaaagctggtaagaagccaatgcattgatatattccgttttgtctgccagtggaaatatatcatcgataatggtattgaaatttgtcatctttaccgttacttctcgtttaagaagagcattggcaatgcacccggcaatataacttttcccggtaccaaccggtccccagaacaaacagcctatatgatttcttttcatttcatcccagctatcaacatagctttttgccttatgcattaccgcatctgacatatctgcattctcaaatgtccactcttccattctgctctcgccaaaacagatgcttgtatttctgctgactaattcccggtgttctttgtctttaaaatatttttgttcttcttcatatgcttttctgtcacaggcacattgcctggaatgtttcttcatccccataaatccatccttggggaaaaatgcttctttcgcttccccacagactttgcagtattgcaaaccatcactgcctacacatacagtatcttcttctctcatcacaaactctctccttccccatagcaataatttacttcatgatatttatttcttttatttttctcagttactttactaggtgccacatttccggcttctgcacagccatttttacgaccagatgatgggtgcttttccgactctattacagccatcttttcaaccgctttattgtcaatcggctgtaaacctatctcatcagagggaatttttacatataaatgattggggtttgaaaaaccaccagatctgcgaaccaatagtcccacatcatccaattccttcaacgctgtttttacagaaaatttgcatttatcgatttgaacagacaattcctctatcggaaatatcagataaacatttccatacttatctatccagctattctttctcgatatccgtgcccggtcatacaaaatcatataaagaaattttgcagtttgagaaattcgcagctttagcaaaaacttcggaaactggaagtactgaagcatctgctctgactccttcatgtattcatatttcattcttttctcgcctcgtttctgtttctaactgttgtaaaaatcatttttatgccggctcaaaaatgtccttacacatattcaaaagatgaagggcataaatacaggctcttgatgaaaaaatttttattttttcctgtcaaaaacacccttacataaaacgaaacgctgagaggcatttttacagccctctgaggaaaacttttttattttttcgattaattgaatacttaaaaacaaaaaaacactcacctattccaggtgaatgtcttatcaaaatttccttattttgttgtctgtgacgcttactcagaaacgcttgcgtatctgctaaaatgtaattgcctgcaattatattttcacgtgggtatggggacgtaatccccatcaaggtctgctactcgtaagtaatacaaaattgtcaaaatgacaatactgtaatacacgggtggatcttgctctagttgtaacatattaatttatacaataataggcccaaatgggcactttcgccatttgagcctatatattatatgtctttgggataatagcttaaaaagtagctgtctagacggtatgtttttatcacaaaattgattttattgaaattggatgtagatttgctgaatttctttatcctcttaaaatttacaatattacacttgtctactattgtaaatttctgagataatccaaatatacttaatatctttgcgggttatatgttgcttgtcattctataattgaagataagcacatattggattaaaagcaatggatagagtttataaagaaagacccacaaccactatagctaagcgcctgcgcttcttttcagtgtttttagtaattgcatcgttcattacaatgtcaacatttccataatccagtcgtaaacactttttacataactatattcgtcaactggaacactatatgattctttggatagtttattcttaattgcactcaatctaagaatccattgtgtcttagcttctttgcctcctgcaatccttgtttcctccggtctaactaacatctcttcaaagaaagaagaccagttttttccattggttacaatcgaaacataatccgctaatgaaacaaaatcccagacattaacatcctctgcatcgtcaccgctatttaattgaagatcatatgctttctcatcggccagtttctttgccttggtataggtatttttaggaaggcctttaactagccaagatgtaccaaaatattcctgaagactatcagatataatagtttttaatttgttctcaatctcgccaatcatgattctcgtttcatcattgaatgttttagcttcattcaaccaatactcgtctaatccttctggcttaaaatcaactctaacatcggcaatggctttctgataagcacgccagaaacgtacatcaccaccgcctccaaacactttcttaatttcttttctctgttctgtagttaatccgttgatatactctgtaagtggcttcaaataatactttaaaagaacaaacatatcttctacatcttgatttttaggatgtatcattcctttttcaaccagcatattgacaaggtcatctagaacacgaattattccatgaattcctcgattgattgtaagcattccatcttctttatctcccttattccattcatctagacagttttctcgaatatacagaaaacatttttcgataaacggataaaacaaatcgcaagactcctgattatcttccaaatcaaaactaccttttgaaatcagctcaccctttttactgtatgtattaaagaaattgcatttctttagtgcagcctgaatagcttcaatggtaatacatcgtcccggtacagcttcagcctctcctataataacacgagaccgaagcggagatgttggttcttcacccaacatttgtgcaatctttgatctaagagcctgtctgcgctcgttaggatctttggattcccataacatatctgcattcaatgttactctaagtgacttcggaacagctttttgattttcattaatatccataaaaagcttaatctgctcagtacgatctaaatccacaaatgcaacaacaggtaccgtattggtgcttgcgtatttcgaatctgaatagccatacaaacgatgttgtccatcaataatataggcagaacgatatctctttggaatatgaagaatgcctaatttagaaatagaaccctctaccttagttgaagtctgatcgaaaaccagccctcttcctccactatcgatgctgatgataatagagtttggaaaatatccaccatcattaataaaagagcggaccgacttcaatcgcgcctttttgataattctctgataagtaggcatcatattctgatttgcttcatttcgatgcagaacataacctactttcagtagtttttcaggttcaatagagaatgaataataggtatatcctcccatttttccttgaatggcaggaatgcggttttccatatttttaatctcttgattagcaaacaaacttccaagcagctgatatcgagaacaagatccaagatgcttagataaattggaatagtattcaaccacagaatcattaaagtaaacgataccagctttctctaatgctagaagatctttcttcttgataatgtaattatgcgtagcccagatgaatttgctctttctgttcggatattttttcagaatctccttacgaaatcctgaaattctatcactgaattgtttaatatcttccgcaaaattgatttctgtcatttcaccggctgctcggcactcaaccataataaccgtttcatcgtctacagctaaaacatcaacttgatgaactaatgattcatcatggaaatcgtaagacatatggaaatcgctgtctgcattcatatttgtaaaacccatacttgcaaacaaaagccagattttattttcaaattgttcttggatggacttttctctagtaacactaatatatttcggattcttatattcttttgacttttcccatccgtcatcaacatactgcggaaggtcatccgctttaatttttagtgtatcaacaacctttcgacgagtacttttagccgaattcaaatctttttcatataccatcttttcccagtttgtatttgacatgcctactcggcctcctttctcgttacaccagggatgttcgtaaaaatatattcttgaaccttaccacgtttggcagacttaccaccaatattacatgttcggtcatattcaagcatttcacctttatccttaaaaattttagaaatttccggatgatgtgcattggtcaggatgaaatacgcatgtacatcgttaatgtaatctacaagattggcaagtctctgctgatcatccaaagaaaacaaagtcggattatacgcaataaacatattattatccgaagacttgctagaaactgcatatggaggatctaaaaacaccagatctctttcatgaatatactctctacaggcaccaaaatctctttccgcaatttccgcaatctgtagtttgtctcttattctttctaaacgatcataattaaattcaccacttctacgaccatagggaacattaaactttcccctactatttacacgataaataccattaaaagaatagaaattcaaatataaaaatctcgcagcttgctcaataagacttactggatcttgttttcttatttcataatacgattctttatcgctcttatattctttcaatttttcagtaactaaatccagattatctctaatctgaataaatgtatttgctaattcaccatttatatcggaaagatatgctttattaggtaaatccaatgaaaaaaagattgatgccccacccataaacggttcgatataattgttaaattgtaaattttgaatcatatcatgcacagcaggtacaaaccacgctttgcctccagcccatcgtatgaaagaagtattctttgccatggaattatctcctaatcaattctattaaatagtatttcgctcttgtataagcgatgtaattcatattatttgttgtatcatcaccgtggatatagacaaccatatctgattccaaccctttaaactcctcgacagaaacaacttggatctcattaacagcctcaggtctatgagtaacaagcttccactttgcaattcccgactcgtattctaatagcagagctgtcttgttgtctgtaataaagactatagaatcgttgttcaagtgttcatcatccaaaaatttcttcagaagactttccagtttgtgtgtgagttggaaatgatcacctataatttcaatcactggtgttggcccctctataggattcacaatcacatcagttccaagatttgttttgtcagatgtccaactataaatatttgctgtattacgaatattctcccgaagcagatatggctgtccatcaattgcaaacgcattgccaaaactatcttccctgaaaatctgcacatcatcatagaagacacctagtttagaagaatcttcacgcaacatatgatttgtgattacagcccattctctggtaaaatcttgtgcttcatcaatatagatagcatcatacttcggataactatgaatgctgtcagcaacgccttcatataatggagctgcatacttctcaatgccacaggatattaagtgaagtatttcttccatcgtttttacatgcacattttctggcatatcttcacttattttatcagctaaattttttgaagcacagagaaataacactctctgagattggtcttcagcacactttatagccatcttttttgcaatccaagtcttaccggttccggctccaccttttatgtaaaaacggctcacattactaagaaaataaacataattatcctgaactctattgattacctgcagttgctgctctttatatcttataagtgcacctgctgctgcagatattgcaattctatcacgaatcagttcaactaatgctctatgctgttccagactatatattcgcaaaccgtaagtggagccaccccaaagcttgaacattttcttaattcgatccgcaagatgatttaagtcataacaatcaattgtacatgaacgttgtctgttatctaagttcaattcttccggaatagcgtagaaaggaaataccacgccggctccaaatattccaggataacgtaaattgtacatatttgaaaaaacactctcgaaataatacatacttttttctgcctgatcatacggagattcattgagttttcgctctccataagttatatcatttagataccaagtgtcattctcttttctgatttgacttccgccttttacttcaagacataaaaatccatattccggattacacactatgaaatcagcttctgatttaatccttcgtccacgcttatatgtagtccaaggaacagaataaaacacatcccagctgtttggaagttgatttttcagttcttggtatacaattcgttctgaatcttccggagtatattctgttatattctttggatacatatttgccataattacatctcccagaatccgattttcggacttctaactccatctatagagtacatgtattttcttccaagttctgcattaaaatgattacatgatatttctgggataatcaaacacccactacaagcagtgtcatctctatctctacaaattggatcaaatacacaatttcttgaatcttcaagtacacgacggaggaagtattcataacgcatctctgccattccggacaatgctccaagcggaatcccttggcttgtttgcgcatagataaagatacttgccgtttcaacaataataatttctgtcagcgaattactactaaggccgctaagctcacccgccatgcgaataaatgcatgtgacatagaatggagtaaaccaaaaacatttttggtaattgattcattttcatcaacatctccgaacatggagatttcatcactgtgcacgtattcggcaaaccatttcttgacggctaaatcatcattcaagtcaggaacttgctcttcacggataatctgatttattcgcaaccattctataatctttttttggctaatttcaaaaaaaataccttctgtatcaagttttgctccatataccagattagcggatccatcttttgtcttatcataagcattcaacttcaatctacaattcttattcatcgatttctttggatcaaacgcacgtctagagtatccataggtacaattcacaatctgaatgtcactggacacctgcatatttgcaatgcccagttttttgtgcaagcgataaacatcctgggctgattctataaagtccatctccatctggcgattaatagaatcttccaaagttatcgttcttcgagcatatttgatagtattgtattgcatgagcttgaaggaaaaattatttagccattctctatacactacagaattcatatttcggaatcctgcgaaaataatatcacaagccttcgcatatcgttcaatactcaaactattagtctgtaatgttaaaatttcttgctgcattagagtatctgccaactcacgcggtattattccctgttcaatccaagcattatatttatcttcaatagccttacgttgtgtactagttcttaaacgttcactaaaagcctctgccacattatccaaaatagtttcgtattcagcctgtgacatttttccaaaccattttgctataatagcttttttggcttcttcacccttcttataaaactcaccacttcttgcatctacaagattaatgatacataaagtaaatgctttatagtttcgtcctgcattcgcattatcaggcaataaacgagaattgcaagtcggacacatcatagcaatgtcaatggacttctcactatttccactcttataaaacagcttgaattggttctcatttggatgatacttaaaatcatgatgcccctttaaaaatgggatacgaaccccctgtgcaaaaccacattcacacgcataaatcatctgcaactgctttactgaatgacgctttttacaatcaggatttgtgcaattccaaacatacctgtcaacatcactggcataatgtttttcaataacatgaccacaagaactgcagtagaataccaatggtgacatctcaccaaaaatatccggtatcccttccaaacactttggttctacgatacagaatgaatgaacatcatcgcgaagatcaaaagatgtaatatcaccgccacgttttccaaataattcaatctgtctttttatttcattttcgatgaaatcatcataaatgtcctgcattttatcataattccactttatgatttttgccgtcactgcaacattggattcattacgttcagaaacccatgtttccggcaaaaatttatatactgcctgatttttactcctcttcatagcatcatcaccttaacttgatttcaatctgttcttctgtatcacgtaaactcctcataggcattaactttccgtgagaataacgtccaattgcagttgagagaaattcctcttttgtaaagttaccattctggataccattcagaatcttggttacctcttctgaaataatttccttatatacaagagacatcttttcattatctctgcagtcatatattgcaattatcatattaatgacatcatgtggtcttatgattccatccatcagcatttttttgacttttaccgcatgatataaatgatctgtatctgtaagaatagtatagtactgcatgataacaccagataaaatgccgggaagtgtactgtatatagcattctttgcccatcgattaataggtacagactccacaagatcatccttattctgatgaaaagtcacaaaattcttcaagtaagagcggtctctcactcgcattaatcgaataatatcaattacaatacccgtatattttcgtccggtacgagaatatgcctgaatatactcagcattattgttcggcattccaaagaaatacatgatattaaatgaatcttcatccactccatgtgaaatagtactggttgccagaataagattcgtactgtctgtatttttcttattggtctgaatatcaaacagtgtttttctaacagtctgaaagtcaacatcactcgtcatctgtttaattacatacaatggaatattctttgccgccaacctattgtttgcctgattctgaaaagcattttccaattcaattgcatcctgtttacggttgttatatacaagttcaatccaatagtcaaaaagcatattttgatattcttctatagatgccgtaaatccctgctgctttagagtctcatagctttcttccaaatggtccatcatatgataaaccacgcggcgcatgaaatatactgattcccacattccatctgtgatagatctaccatatggtgcataaccaaggataatgcgagtaatatcattctcatccgtatatgaatagaaatcttctccattctttacagacggatattcacaaggaaaacgtttgggttccatatgatataaattccgtatatgctcctgatacatagaaatagtagcagttgcaccaataaaacgaattttctttctatgatctggttttaccatccgcttagcataataataaaggaaagattcgtaatgggcatcaaatgttcctaaactttccttaatcaagtgcatctcatcctgaataaaaagagttggaacgggatctttcaaatatccaacggcctgaacgcgaccactgcaacctgattctgcacaagtacacttggatccagttgaaaagccatgaatagggcaataacattttacctgcccaaacaatgccttgaattcgttactaataccaatcaaagacattttatcaatggtactaaccacgatggacggtaagtaacgataaatttcactatcaacaatgaacaatggaagaacatctgccggacaatctggattatcacaaatatgctctagaacccatcgttctttattgaatcgaacattaatcatctttttaccacaacatgggcacttatctataaaacgatagtattcatttagtgtgtcttgatcactttctaacaataaatccaagttttgctgccgttcgcctctgctactgagcttttcattcttactgatcttgttaggtgtattatcttttccaacataaaaaccaacacgaaattctgtagccaaagcaagctctatattttcctgccgaaccacattagcttgcataacaatagcgagtatacgatccaactgctgtacagccaataatcgaagagggtatttcagaaatgcagtgattccttgagtctttccgcgaagtctatcaaagaacatcgcaaatacagtgataccaaggaatgcctctgtttttccacctccagtaggaaagtatagaagatttgccacatcaatatctgcatatgtcagagaggcgtcatcccgatactcactgtgaatcacttcaccgatcatggatacaatgaatacaatctggaaaaggcgccatcctgtaatatttctagactgaccatctaatttggtctggaaggttttattcatgtaataaaaagctttgcgaacaaagtctttatattctatttgcttgataccattgtgaaaacgagagatttcattttcatattctctcaatgcattctggtatttcaaacatgcttgtgaagacaatttgctcctacgtgattcaaaatcatcctcacagcgaccgtaatcttcctccattttcaaaagaatatagtttaggtttacaatagggttctgtatcagcttggcaaaagtgacatattctttcaaatcatctttggttaccaggcgtttttgataatagattggaatgttgtcggtacggatttcatttctttccatatgatacttggcagaagcattctccgtaactgcaaaaattggatttctttctttataacttccactaaaatagtcaagtggaatgttctgaaattcgattccttcattaccttttacgcgtatgcctgcatcaaagattttgggaagatatccaatatttttcttatcatttataggtgtagtgttaaccatctgcagtaaaaatcgcaaagtattcccctcttcttttacattacacacaatatcgatatcccaccgtggctgtactctttcatctttgattcccgtcaccacacgaaatctatcaggttctgttaaatcaaagaaacttattctactctgagaaacaatacagatttcattcgcaatctgatccgccaatacactcagcttttcagaaattttctgtttgagatgaaatgtctgtccaggcgtaatatcagaaagcttaatctcaattccatccgccatcacagaagctatatctatttttttatatgttaacgggagattgaatttaatttctggataacattcacaaagttgtaaaatatcagtataatgttcagagtctttttcggaatatcgttcaagcatatactgaactgttttctcataactcggctgaaccatataaaacaataaaccagctggaataacatgaagaatgcctgattcattctttttcacaataaaagaaatgctgatagaaggaatactgtcaaatcgtgtatttgtgttctcaacatatccaccttcaaacttagcttcaactctatcctctgaaagcatacctaccataacacgtttagaaggatcatcatcaacaaaagtttctcccagatcttttcctgatacacgctctatgtattttgatacgatataattcgccattatattatagttactcgccataattcacctcttatttctgcaaaatttcctccattggagatcctggggtcaaatcacttaagacatacaatacatcccttgccctggaacatgcagtgtacatagctctcatctggctctgcacttgcgactggtcatcatcagacatcgctttaattgcagcccaagaagatattatcttcttgtaatagttatcaccaaaaatataattgtaaggatacaaacccgctacaataacagctttgaaatctaatcccagagacgaatcaatggtcgaaacaacaataccatttgtatcgctatatctcttacggtcaaaagatcccgtcaaagaggatgtgatcaacgaatacggtatatccgcatcattaagtgcctgctctaaccaatatagataatgatatttaatctgcctgcgttgcttatacgggaatagtatagcaatctcagaatagcttattctgtattgagttacaatttcttttattgcattaacggtttcatccttaatattaaaacggtcaatgcccatcttaacctttaacgccaaactatttttatcactgatttcgaaagaatcatactcgaattctttgaaattaatcatatccaacattttcattcggtcattcatatgctctagcatatggcaaagatattttccgatttctttgctgtttcgataattcttttttatataacgaacacgtcccgtgtagtctaattggattcccgcaattttcttccatgggacatcaccacggcgacttttcttacgaactgtctgatttagatcgccaaccatcaggaacgtgttatcatctgcatcttctaacagcaaataacagagttccagatacttcggatcaaaaatttgaacttcatctataaatattgctttaaatcgaagagataacttaccggttcgtacaagatcaatacaacgttgtatttcttctggtgttgcgatattcgaattacatctctgatgcaaacattcctcataaatcttctttaccaatttatggaatgtcataatatgtaaattgcaattattttcaaaatttgcacagcttcttttaaagcaatacgaatcggctagattgttgttataacacgttaataaaatctgagaatctttatacatactcgcatatttaaaagccttagataacaaaagcacgcttttcccagctccaggatttgcaagaataactctatgtccacgccccatatcattaacaaggcctacctgatattcatcgaggaaaaaagttctgtattctaattcatctccagtaatacgcatctcttcttcggaatgaaaggttctatttacaggtacctgtacattttccatttcattcataacaaccgtgtattccggtgctaatctttcaaatatagctttctgttcaatatcggaaatttccttgaaattcggatcatattcttttcttatgtattcgaaaattttcagatcttttttgtattttatcgttcccgttatatccactggatgaaaaaatttataagatgcatatgctgctaaacgttgtaattgtgcattttcaaatttagacttgccagtaagttcattttgaaataggatcatatgcttatatggaaatttaagtaccttatactctcctgctcgaattattaaaatcttcgaatctaagagacgctcatatattttgttctctactgtctgcacatgattgatataaacatccatcaattgcacattaatatctcccggaaacaaggaatacgtaactaaaccttctgatggtgataaatacattcccatttttaaagttgaatcactcattctcacaggatctatatcaactacaaaatgtccatctttaaaattcttctctgcattacgaagtaaataacgttcataagatgttatatgctcctttttaacataatcattaggccataaacggataggcataagataatcccccattccttagtctattccactggaaatatatccataatatctccgatattacaattcaaagctttgcaaaccttttttaatacttccatgctaacgttttcattttttgacatcttagttaccgaagtccaactaataccagcttctttaactaactctgttttattcatatccctttttaccaattcaatccataattttttataagacacttccatatttttacctcttattagtaataaacacatttttagtattaattttaatggattccgatttaactattaattataattttatcatatatactctccacctacaatgaaattctctacaaacacatgaattttcattctatttctgatatatcaaattcaaccgctttcattaaaatcgtactctgtggcataaaatacacatcctgccctgcttacatacatacaacggctaaaaagaacactgtaaacagctagataaaactccttatatatgcaatggatgttctgacataaacaatctcaatactataaatgttcttcatcaaaataaaaatggcgaagtgcttatcgtaacactccgccgaaagcctaaccggtttgagccagaggcttggttaggtctgctttattattttatgcacttccactgcatttatacacttaaatgttctttccaatccgcaggaagattcattgctgcgagactgaccacaccattattattttgaatcagcttatcgaaagcatttacaaatactgtccactcctcatcaaatgaacgcaggtacttcatcgccagtaagatttgatacaagccattatgcgctggtggtggcgtaattttatctacatcaagaatctccggcgtcgtatgaattgtacgattataaattctggaattatgagcacacatattacgcaatactgaaacaccctgtatccatgaagcaagcattttctgtgatggttttaccaaatttccttttttcgatctatactgataatttgacgccaagatagagtatgaacttccggtacctgttttcaaattcttaattatcttcgataatgtaccgaacgaaaggacttcaacggctgcccatacaggtacttctccatcataattgtcaaaattatgtttgataaacacatcattagagcgagcaatttctgacgctacagtagccatattctgccaataccgttttttctctttaaaaatcgatgaatcttgcaaaacaagtggttctccgtgtataagcaatgcttccaccaatcgcactctcaaagcaacctcaatcttagaaatcattgaaaaaaccaaagcagataattcctgatcaaattgatacaattttataatatcttcaaactttgttcccggaacatacttctttgcagcattatcatataattgaaacgaataacctctcaaacgataaaatccaattgacttcaatgccttctctacatcttcttgagatgtaatcttcattcctgcatccacataagattgcacctgctgttctattgttaatatttgttttggatattgatacataaaacaccccataaataagaaagtcccaccgggttgcgcatgaaaaatcagaggcgtggtgggttctgttaatgttattatacagctttcaatgccactgtcaagattgtttttgtaaaaaaatcagcagtctatttgtttcttgaagttatgctctcattcataaattcctatttttcaaaacatatctcttgtagttaccatatgttttaaataccaatccgatcttccaaaggtgtaaataaggtgtgaattctacgtttccatccaagaaacccaataaagtcaaggctttttcccccgttccttaaacactgccgtggcagatgaaaagcacttttatcatatgattttctccttgtgttattgaaagattgtgtaatttgaaccctctatgttctcaatcacttaatgatatattttgttcctctgccttttccttcaactgcaatcacaccctttttctccatagctttcagtaattgtgttgtttttgatttgccaaatgggacatatggtgcaatttcacttattggtttcagcattgtcttacttaaaaatttgtaaatcactttttcgtcttcggttaaattgacattcgtttcaaatatcggtaatacaatttttatagcattttctgacacttcaaattctggttttatcaaactctctgcatacagttgtttgattcgtgtaattcctgttccaaatatctctaccaatcccagtctgtaaaatacatttgcaagatttctatttcttaaaatagatagtttacctgataaatattcttctgccgttattcccgccggcaatccaccaggagacactacttctattctatcatcaaacatagaaactctgatgtgtgaattaatatcccatatcctatgaatcaaagcatttgcaattgcttctctgaaagctgcttccggtattttctctaccatctttctgtcagctccctgtattacttcatattggtaataatctctaaatacagcaagtgctttttcatatatttctaaaaccgatatatgttcaaacattactcttttttgaataatactgatattctcaccgaacttaacaatatcaattcctgaaaaatgatttttatctgccaaaagtcccgctgcattattataaccatttatattgtcatacaggttcaatgtctttaaagtatcttgattgaaagtttcaatgtaaatattttctttcagtttacactgtaaaattttaaaagatagctcctgatctttacaaggtaattcttcgaagctaatattttttccatctaatacaagccttgaaaattccaatgtatctacctctatcgttgctgtatcatttcgtttgtatgcttttgatttatataaatacggtttttgaagaccactttttacagtaagttttatcgtctggtcattgttctgtatttcaagtgtatagtttggttgaggtgatatactgtcattgattttattttcgatatccagacaggcatgttttacatctggcaatcctttcacatttccattatcatcaaccccaaaaagaattgttccaccattgtaattcgaaaaggcactaactgttttcaaaaaagtattcgtaattgtttccttgaattctaatattcttgtttcacgcatagtaatcgttccctttccaaccataatgattatattatatgcaaaaatgcgcaaaaaatcaatcgtatttttttacgattgattttttaattgattttgagtgtagtattattttttgaccaactgaattatgacaacttttttaattattccgattcggtcttccaaaggtgtaaattatttgtttctatctagaaaatcctacaaaatcaagtctttctcgccatactttaaacgttgccgtgacatataaatagtattttgaccattttttatctcctttcgtgccaacggattcaaggcgataagcctttatttttcaacatttttgcacattttcatatttaattgtttttcgtttctcctcataaatgagggtattttctctatagctttatgcgttagaaaggggctgtgaaataagtccctaaaagaaataggaccattcgttcatgcgaaaggtcctatttttgtggtaaaattaacttgcgatgaaaactttacacaataattattgtaattcaaaacaaggatatttaccactgtttctttcagattatttggatctgctggatcctgttttaacatttgacagattgatgggcagaatcgatttaaacaagtatctgacggatattccggagtatacaaccggacgactcagatataatccagtcaacatgttaaaaacagtacttttcggatttatgactagcggctactgctctctgagagaactggaagacaactgcaaagttaatatcaggttcatgtatctcatggatcaccagactccgtcatacagaacctttggatatttcattaatgaaatacttcaagataagattgaaaacatttttaacgacatcaatcatgctatctttaacgaggagcatgtagatctgcaacatctctacatcgacggctccaagtttgaagcaaacgcaaacaagtatacctgggtatggaagaaggctaccgaaaagttccgttacaagctttacgaaaaaatcactgcggagattgaggaaattaatgcagaaatcgcatggagcggggtgcagatcacaacaaatccggagtatgtaccggattatctgaatgaaatcgttgagcagctagtacttttatgggaactggataaaagtacatttgtttacggaagtggaaagcgaaaatccaaagaacagcgacattatgaacacttgactactttctgtcagaaacttcaagaatacatgcaaaaaattgaaatctgtggtcccaatcgaaacagttactctaaaacagataactcagctacctttatgcgtatcaaaacggattacatgggcaatgatcagcttctgccagcatataatgtacagattggtgtagcagatgaatatattgcagttgttgacgtgaaccattatcgttcggatatggattgtttcgttcctttgatggagcacttcaaacaaacttatggattctatcccaaatatcctgtggcagatgccggatatggctcatacaacaattatattttctgtgaacagaacggaattgaaaagtatatgaaatttccaatgtttaaaaaggaaactaaggatcggaaatatcatgaagatccatttcgtgcagttaacttcagaattgatgagcaaggtgtcatgagatgtcctaacgataaagcattccattttttatacagaaaaaatgtgaggggaaatcaatacggacgtaaggaagaactgtatgaatgcgaagactgtagtggatgtccatatgcagagaaatgtaagaaaacagataagaatcgaaccgttcggatcaatcaggaattaacttccatgcatcaggaggtaatcgaaaacctagaaagtatccacggtgcgttattacgaatgaaccgttcgatacaagcagaaggcactttcggaataatgaaaaacgaccgttggtacaagagaattgtccgaagaggcattcattcagtcaaactggaagttttactcgtggcgataggccataatctatataaatatcagaaaaaaaagatgagaaacagaactgccgcatagattcaaaaaaagaatttctatggggtaggggaagtgcgctttctttgcgcatgatttcagtcatttatacacaacaggtacaaaaagggagatgcgaaaaaactcaattgagttttttcacatccccgaaaaatttatattttttcaattgtctacttgacggggagcagttcatttatctactgtaacagcctcgtttaacatatctttatgataggcttattgtaataattctttgttttactgtcaatacttttgattcgcttcacagaatcttcatttttagcatataggacggacgcatgccttaaccgccagcacatttttgtggatctggctctgccgcgctgattcccttttcctgattcaggcgaagatcaagcggtccgtctgcacggaaagaaaaaccacgcttcagattgtcgatctgcatgaacgatcccccgaaatctgcaagaataaaatcaaatccaccggcttcttttgcaatctcatcgattgtacagaaattctgaagtttgaccgtcagaatgtcctctccaaagctctgctctgccagacgcttacgaggctatgcagattcctcctgatccacatctgttgcatacatatgaccttcaccatgcaggcattccagccggagtatttcccttatatcgtgctcttcgtttgtgtggtgtctgtgtttcctgttccatttcgttctccctgcctattttttataaaaatcattagagtcatattcgcatgtcagcgttttaacaggaatttttctatttttatcttcgattttttctacaatcatctctccggcaagttttcccatttctttcattggctcatataccactggaatcctgtgcatgaagcgatttgcaaaatcagaatccacaaaaccacctactgcaatttcctcgccgagtttcagatttctatcctccacatagttcagtacactgtgagtcattgccgtatttgtggctataattgccgtacatccggcctctaccaattcgccagctacatcataggtgtctttttttcggtcaatatatcgaacatactgttctgtctccggtatctcatattgtttcaaaatctgctggtatacttttaccctttcataagtcggactaatctgtggcaatccaaccagaaaaccaatctttctgaaaccattttggatcatttcttccagcatctttgcagttgcctcctgacagtcaagaataacactgtcataatttctgtccgggagcacccgatccataaatatcattgggaatttgtccggtatctgcctctttattgtctgaaaatcttctgatgtagaagcaattacaatcccatctacgacccccgaagccagatttctcagtgcctgtttttccatcttgaggcagtcccttgtattggaaatgaccagattgtatccctgctttgatatcacatcatctacatcttcaataagtgcagcaaaaacagagtttgtaatatccggtacaacaagtcctatcatcattttttttccggtacgaaaagtcctgccagacgcatctggtgaataccccaattcttctactgcatccatgactttttttctggtctcttcggatacaaaacgtgtatgattcaacacgtgcgacactgtagatatagaaacattggctttttgagccacatctgtaatctttgctttcatatacattcactctctgtttctgttaattttatatggactatatgatttcctgtcagactatatggtataaaatcaaccttttcatcatccagtataacacattcgacagttccagttccacttattttaacagttaattttgccgattgataattcagattctgtatttcaatctctttaaatatttctggaacacacggattaaatctcatgccctgttcatcataactaattccgaaaacaccatataaaatctgagctgcaaacccgcaagcatgccaaagttgtccgggccatctccaggattttcctgtatccgcttcaagaacttcatggaaatttttatgcaaaacagctgttctcatctgctgtgcaatcatagtcagcaataattctttattctgcgattcagccgcagcagaagcaaatcctgattcccacaccggccagactggtcctacaaaatgattatgctctttgcgatgaggaaacaaacgtattccatatggagtcattgcagtatgtattccactgttcaggatttctcttttctgctccggtgttgcaatatggaacttatcccacagagcggcttcctcaccggaagtctcccatatctgattttcatatgcttcactgccttttggaccacttgtaaagtatcctgcctcatcattccagtattcttcacggattttttcacataattgttcggaaatcttactccattttttggatttttcattttctccatgcaaaagcttttctattttggccatagaatcatatgctttcatataataacattcactgccaagtgaatatcctgcattttccggttcagggaacgcatcattagaagtagactgttctgcacgtacaagacctttttcctcattatatctgttttcaatttctgtcattgtttctaacagtgtttcatatccctcttcaagtgcacttctgtcacctgtagccagataataatcccacaatccaacagcccccattgccggtccgtcacttccattgtcaaatcctttttttacagcatacaagagtgagcgtcctgctgtttccggatcgatcaggtttccgccacgcattgctatatgtacagagtctctgagccagactccaaacccttcacctttgcactgaaagagtcctgcctgccacagatgctcctgcccagggagtgcatagccaccattcgtacaacgatcgaagactgtcatcgccagattccatgttgctgaaagaatatctgaagcagatttcagtgtcggatattttttcagtgacagatctgcggtccacttatcagttctccatgactttcttgtcatgtcgccccatttcgtttttctccactgaaattcttcaagaatcctgtctgctgacacaatttcctccggactgatgatataagcatctggtctaccataacagctgtcttcaacatggttatcgaaaactttgaatttatcatttgcgaaaataagcctgtcctctttcttttttcttcgcaatgcttctgtcgcatctttactgtatgccagtcctctgagtccatatacaacaatctcagtctctgtatctttatccgtttctacttgaatatgtggatcattgtcttcgcctactcggattttcccaagatttccactaatatcaataacactgatttcttttgctttattagtcagattatttagcagtaccaatactttgttatctgcgattatttccgtcagatactgatcaaatatagtgacaaaagacagtttcttatcgcattttatttccatctgatactttccacatgtaagcacttttttctcagaattccagcaaagtttttgatatggaagttgaatttcaacctgtttttcactgtttatttccatgttaaatatggcttcataagcatgtgcaaaaatatcatcgggagacatgtctgcctctttgatttttatattcggccatgtatccggtgctatacgaaatctcagtgcacaatccaaatttgatgttttttcgctaaattcacgcttccagatcctgtgagaagaaatatctgtacaaaattccccgttttctcccgaaatatagggaatcgtgatgtagttctgcataccatcagactctgtcaatgcgtaaaccacttttttatcatcgtatccaaagcaatagatttgcctgatatcaccataaatgtttacattttcacacttcgaaagatcattttctgcaataaatttttctgcagattctgaattaaaaaaagtatttgtttctgcatctagacagcagatttcactctttccgtactcttctgcttcatattctacctgcagtttcgtctgagcataacccatttttctgagttctgtaatacagctgttctgtctgaaataatgtactgacttttccagagctgccctgtattcttcttcataccgcctgcttccataactttctctgattttcacaagttttccctcctatttgatgccagacatttttatactgttctgcaggtgactttgcagaagaagtgatatcaagaataccggaaggcatgcaagcattgcacttgcaataaccacattccacttagtattatagccacctaccatgttagcaagataaaccataactgttcgatattccggtttcttatttacaatcaacggccacaggtaattgttccagttccccaggaaaaaagcaatactcagtgggataataattggtcgtgaaagcggaaatatgattgtaaaaaacattctgtatgtagaacatccgtcgagttttgcagcctcttcaagatccgcagggaaactcatataaaactgtctgaatagaaatataccataagcattaaacaatgccggtaacagaattccagcataactgtttgtaattcctaattgtttacatatcataaacaaaggtacaagaatagacgataccggaatcatcaaagtactgatgatcactgtaaacattggctttttccccggaaaattcattcttgcaaatgcgtatccacacattgaatgaagaattaaagcaataatcgtaactgctactgcaataaggaatgaattaccgattgcaacaagaaaatccggtgttatcgctgattttatactttcaaaagaaggagatgctgtgatcagtgatcctacaaaaacagttttttcatttctgaaacttaccataaataaaatgtaaatcggaaacaacattacaattcccaatattataagaattactgcaagtatgttatttgtttttttcttcatatcatcattcctcctttccatttatttttaacataataacggcaagcactgtcaaaattagaaacattacaactgacaatccggctccatatccagccttcatcatttcaaatgactgtttgtatatatacagactggcaacttctgtcgattttgccggtccacccccggtcattaccatgataagatccagacactggaacgatgcaatcactgatgtgatcagtacaaaaacgctggttggctttaatagcggaaacgttatcttccagaaagtctgccaggaatttgctccatccagttttgctgcttcataatagctgtaaggtatatcttttattgctgatagaaaaagaataatattataacccagattgatccatatcaaaacaactgcaatgcaaaccattgcctgagaagtagatcccagaaacttttctcctttcagtccaaaggccttcagaaatacattgataaatccacttctgtccatataaagaaacatccacagacagcttgcaattacagatgtgatagaatatggaagcagaaaagctgtttttacaaatccggcagctttttcgtttttgacatagttaatcaaaactgcaaataatattgataatataaataatgccggaacatacagtaaagttaatttaaaagttcttcccagagactgccaccattcagagtcactaaacattgtgacataattctgtattccgataaattgcttaatgttagcgaagttccagtcatataggctcatataaaatgaatatatgattggtatgataataaaaaccagaagaccaataaaatcaggaagaacaaatgtatatgttacaaacatctgtttcaattttttaccggacatttttcctttctgcttcataattctacctcttgatttaatattttagtttaatgcctcaatctgttcctgtgccaactgtgccgcatccgctcctgaacttccgccaaacatcacagactgcaatgtatctcccataatatcagttacttcagatgaatactgtggttcaggtcttgccgtatcataaaattcggtgaatattgccttcatgccttcctgaaaaagttctttattttcttcaattacagactggcgcgccggatatgcaaatttggcttctgtacaccattttgtgacataagttgtatcatcacttccaaagcaccagaaaataaagtcagctgctgcatcaacatctttgctctggctggaaactgccatcatctgacctcctgcaacagttacaggatcttttcccttcggtgacggaagtggtacaactccaatattatgcccatctttgttgtattcttctgctgcatttatcatatatgttccgccaatctgcatagctgcgacgccatttgcaacattatcaatactccatggtccgttctgtaatgatgacgggcagtattcattctgataaaatgaaccccagaaatcaagagcatctgccatgctgtctttgccggccgttacatttccatcagcatcataaatgtctgcatcatccatccacataaatggccaccagttaaacaacgtatatgctgttttttctaccggaagaacaattccgtatctgtcttttgttgtgagtttttcagctgcacttttcagttcttcccatgttttcggtggttcaataccttcttcttcaagtgcatctgcatcataaaacagtccaagggtttcacactcaaatggcagtgtatagatttttccgtcatctccgcttgccgcttcaagaaacgacggaagaatatcttttttcagatcatccgtataataagaagaaagatctgcaagcatttccgcatccgagaattttttaaaagtcgccggttccacccagaggatatcagggcattcgccatttgcatatgcggttgtcacaagtgttgtcgtataatctgtctgattgacacttgaatattcaaccttgactttatcctgtgactgattatatgcatttaccatatcctgaataacatctgcctcagttcctgtatggaaatcccagaaagtaagtttttctttatcgccctctgaagaatcctcttcaccggtattattttctgttcctttttttccagctactgcactgtcatctgatgtactgtctgaactgcttccacatccggtaaataccgctgctgtcatactcaaaaccataatcattgataaaaatttttttaaattcataaaaagcccctcctttgctacacacgtgcttatttatttttctttatcaaattctttctttactttatgtgccagttctttgtttccagtttctgacggtgctgttcttgctgcattgagtctgatctgttcagccttttcaactttaaatttttccattctttcatttctgcttctgtaagcttcctgcatctccggtgtaagttctacctgatgagccggtttcggaatatcaaaagttctcttaagcggaattctctcttctaccggctgaatcgttactgaagtaacaggagctgcctgataccagtacgctgtgcatgaccagtcatctgacagatgatttgcatgaccatgttccatgctgatctgaatatgctttttaaaatggatcggatctgtaagatggaatctataggatacctgataaccttttgtatctccgtcatgcataatcgtaccattataaggtgactgatttctctgcattccccatgcatggttaaaataatcctctgcaccagttccattaatacttggttcttcttcatcatcaatcaaaatcatgtcatcgccttcgccccaccagctgccctggaaatgaagcacagaaagattacaaccaacataatgaccacggccttttgtatccagcatcaggaaattctctttaccgtcaaaattaggaacactgtttacttccggagagtttacgcaaagatcatttccccagccactgcatggcatatcacgtctccatgctgcctgaaaataagcaatatccggagtctcttcgtgataaagttcataatcaatatggaaaaacaatccaagtggtctttcattttcattgataacttctattttggcccgtttgttaaacggcatcggaaaatagcagttcatggaagccgttccaccaaaagtcagttcctcacacggtcttgaagatacattaaaaggaattgacgaaaaacttgacggcatagaatgaccaatacagaagaaatctcccagcggtgccagcacactgggaccatcaaaatcatcccaggtcatacgaatcaggaccttacggtaataatccggatcattgatttcccagttaacgccttccgcattttccatttcagttaccggtgcaacagagccacttaaaaccggatgctgaatagacggtccgagaatttctctgcaaaaagtcgttacccagatatgattgatgcaacctggtccttcaacgtccgccataaccgctgtatcccctgcatttacaagccagtaatctttatttctgccactctgatcccagcttgaagctctggcagttcttgcatctgctactgttgtaagattttttaaaaaagacatattatttttctgcattttttctcctcctgattgaactttctgtagataaacgtttgcgcaaacgtttttatgtatttagtatatcattcactttgaaattgtcaattagtattttttaacaatattaattctcaaatttcgttaatgttttttttgcattcattatttaaaaattatttttacatgtctcccattcctccaccggatcgagagcgtatattgtttctttgttttcctgattaaatactcctcattatcttcatgataacgaagttccggattttcatctcttgtcctctttattttctcttgtaaaaaagatgtattaatgacataagaagggcataccagactgtcatccaatccaagccttctgaatctgtttggtaaatcatcaaactgaaggtcaaatacttctttgattttgccacaaagcttttcattttcactttgtatagcatattcatacaaagataccaacactgctttatatggtgcttgaaatgtcgacatatccgcagttattggctgagaaattcgggcacgaaaaaaagccccggtagtttttcttaactactgaggctttcgtctctttcttgtattcagttatctatgccctctttcatcagcataatcattgtatcaggataaagttcacaaagtatccgcaatacgttcccataagttcatgatattagtggaatcgcgcacattttagtacagaatgttcaatacaatactgttatcaaacatttcattcccctgcctattgtaatttcccatattcttcatcacttaccggttcaagccattcattggaactattttcgcccggaacttctattgccagatgtgaaaaccattcatccggtgctgcgccatgccagtgttttacttctgccggaatattgatgcagtcgcctggcttcatttctacagcttctttaccttctacctgataatatcctcttccacatcaactgtatacactctatatacaggctatcttgttacaccagtttactgcatcctggttcgaatgtcacattgaaaattccaacctgagaagtagaaatcggtgcaagaaaactcctgcccgaaaaatactgtgcaaagccatcgtttggtgcaccaattggaaataccatcttttttgcatgcgcctgcatcgcttcctcttcgtatgacaaatctccttcgcctgtttcccacacttcctttgcacgattgaaaacagcccatgcttttggccaacctgcataaaatgcggcatgcgtgatcactgcagcaatctctttttgtgtcacaccatgattttttgcattttgaagatgatatcttaaagaagaatccgtaattccggaagccatcagagcaaccactgtaataatgcttcttgtttttacgtcgatgtcctgattattccagttttcgccgaaaagtacatcatcgttaaaatgtgcaaattccggtgcgaattcaccaagtgtatttcttcctgctgtctgtactatttttcccatattctgtatacctccataacgctgttatttataaagagtttatccattcagtgatttcctgtttcgttccacaatttaacagtctgccttctgtaataactgcgtctgatgcagatgactgcaattctttcacagtgttcccaaatccacttcctccggatgttgcaaaaagcacaatctttttaccactgaaatcgtaagcttctaaaaatgtattgatgattgtcggagccacataccaccagattgggaattaaaatgtagccagttcccctcatgcgttgattttactgggtttaactgtatacaaaactgtgtttactgttactatctttcattcttttccaaaatagctttgaagcataggccacattattttcatatatgacacaaagctcagctctacttgtgcttcattaaaccatccaaccataaagctatttatctcttcaaataatacttttgaaagtttctgaataataattgtgttatccacttcttcagtataatctttcgcatacattttacatatagaacgcactccaaaataattatatagcacacctaccgttgtttttaatgcttcaatatctcttggaaaatctgttctattcatcatattcactactaattgatgtcttgagtttaggtaattcctaactgtactattacctatttcaacatcaactgtaaatgaaaaatcttgagtttgtatactatctgctcctaacattatcatcaattcaacttgtgctgcatgatattctgtataaccagacaaagccatatatttccaagaatcttgctttgcatacatttccgtatctaaaatatgcgtaaattcatgaaacacaatataccttggtatttccgaacttttgcatatccttaatatatgttcatctgttttcgtattatagtaagcttgggcggctgaagcgaatcctgctgcatcgctttcctcaacattaatttcaaaaaaatctatcttatactgtggtaatttctcaatttccataaactcaatatattctttttcatattctttaattaaatttttaatttgtatttctgtcatattgttttatacctcatatcaaagttagcatttcacttttagtataccataaaacaatcccattctcattctatatattttatcctcaacgatgaaaagatgtgtctgcacacatctcttccatcttattattttcaatgttataagttcttaataaaattcaaatcctgtttccgtaatgccttctgtaacttttcgttctttctcttcagttccttattttctctgctcagagctgccaccttctggttcaacagttcaatctgtttttccatcgccatgttcagaatttctcttcttggatctatcattccggcctgttgctctactgcttggttcaatgtatcccggacggttggatttttataaaagaatcctctcgacaatccagttttcttcatcagctttggaacgctgatacgttctttatttgccagcatatcttgtattgcttgcaatgccagttcaattttctctttactttttctctgattttcctcaatcatcttgtcgtatttgctcatattcttcaccccatcttgccagactcatatatatgatgtcactcatcctctgtcttacttctctggtttcgtctgccattctttgattgctcattttccggtaatgctgtacattattcagtcttttatgccccaatagtctcgctatcgtccagtcatccagatgcatttctgtaagtttgacgccatagtagtgccggaacatgtgcgttccaaacccgaataattcgccatgatcatctttcaactgcttttcctgtatcatggacatgacttttgtttttatagccatatactgcatcgggcggtcaggttctttttcattaacaaatatgtattctgtatcaccgaacttttcctgtgtatattcaatagaactctgtaacagttttgcaagttctttactgatcggttttttatatcttttagttttaacttgatatatttcaatcatatcttggccattttctctcgtcagacaatctggtctcagtgtaagggtatctgatatcctagttccaagcatctgatgtatcagaagacatcttgcaatctgtacatccatctgtgtaatttccgcattcagtcgtttcatttcatcatcagaatacactctaaattctgcatttacttccggtggaatatccgtattaataaataaatgctccaatctttcatagctgtaaatttttccgattgtctctaactgtcgtcttaatgaaattacataagaactattcgcactatgggaagtatcttttgttgacagatgtatcaaaaattcttccagcacttctctgtctatttcactgcaactttttattttggaatactctttttggagatattctgagaatatcctcattattgtcagttctccctgtacagttcctattgcttcatactgtagattcatataaacagctttcttacattcttcccggatatctggctgatatatttttctgaaatccagtgtttttacattataaattggattggatctgattttaatatccagattttttagttcccaaacatctttttctatctcatcccgtaaatcttctggctctaaaaatttcagtacgtttctgaaatataatatcgtcactgcttcgccatagcttactgtaccatacacactcttcttttcttttacaatggttattccctgttctaacatccagccttttaaaagtgatatccatttttctggatttctatctccaaggcttttgattctccgatttattctgctgttcaaaaactttgcaatatgattataagctgttcgatcctgaatcaatgctctaaacgttccgtttttgcagcgatacataatataacctcgaaactcttcctttaattcttgcgttggaagcaacgttaaatcaaattttccattatccttacgtgtccctgtttcttgtaaattggggaaatcgctgaagtatataatatcattttccatctttttcctctttctttagccatgatgctaaactacttccttgcatttcaaagaactcatcatttgcttttgcaatcctttgtggcatataatcaatatactgtcttgtcatctcttcataagtatgtccaagataatccctgatactttgcagtgatacatgactgtcataaaacatagttgctactgtatgtcgataatcgtgtgattgaaataaatattctccatttgcaatcttattttcccggcacgcttctatcatctgagttcggaatgtgccatatagacaagcaccacctctgttgtttttaaaaatgaattcttcaggctgaatttcatgttttttcaagtatactttcataatctgataaagtgcctgtgggattggaatccttttataattcttcattttgacctgatacacctgaatccaataatcctcgccctgctgataataagcatttcctttcaatgtacacacttcactcgcccgtaatcctagacaccacagatgtaggaacatacatcgtaatcgctctggaaaaagatataattttttcaaaatttccatatatactgtttcctcaacgctacgatcatgatgtactactacttctttttgttggaaatattcaattcggaatggcattcttgtaatatactgtttaacttccatgaatttataaaaatgaccgataccgaaaattctttcattaaatccctttgcctgcattccccgttctcgcaagccgtctgcatacttttttacttctgcgacagttgcatgaatcgccagtatcttttcttgttccagcagttcaataaaatttctaatacatacaaatcttcgtacaatcgtgctgactgcctgtccagtaattcccagttcatatttcatgtatgcctgtaaaatttctcgattctgtatttccttgacttccataaaagaaatgctaattaaggatttactttcgtctatccgatgttttccaagatgtaatcgttccagataccatacatttgcttcccattggatctgttcctgctgcataaacgcatctcttctgcattcacctaaaatacttcgttgactcgtttcgggaaaattctttaaaatagtttccacttgttccatttccagcaatccaatatccgtaatatttaactgaacacaagaatcataaagaagttttaaggattttaacctgacatttctataagccttagacattgaagtatttgcaatgatacgactcaacgtataaaaaatttgtttctttaaaacttctgaacaattttgtgtaaaatcccacaccaataggtttgttttataagaagtttcaaaggtctcagctatttccttttccggataatacttcagaaaataaattttattttgatatttccattcatatatccgctttccatttagcgtctgcatctgttgatagatatgttgttgttttaccgtatcatatattttcaaatagaaagatacaatttgtgatcgtatctgtcctcttaaatattgttcatacgaatttcgcaaaggataatccatttcttccagatgccagatttttctatctgccaagaactttttcaatttgttaattcttgaatcgctttttattccaagtgcatcaatttctgaatatagttcctgctttttcttctcaatatctacttcagattctgttatgtgttctgcctgttgcaataaatatataggtatttctcacacctccctactccagcagacgttccgccccataaatagcagtgtgttgtgcataaaactcattacttgcttctatcagttcatcatccagccagtccagatactttatagtcgtatccaaatgtttatgccccaatgcctgactgatcatttccagttcccatcctgcctgctttcgcatatttgcaaaatagtgacgtaacatgtggggtgtgattttaactccggttttcttttccattcggtccaacatatcatatacactgtccactcttaatggctttccaatgttctcacccatgatattcacaaacaggtaatcctgatgttgcaggattttccgatattttgccagataatccatgagaaattcaaacgtatcattacttatcttggcacttctgtattccgcatttttggctctcgcttcattttcattatcttcccggaagcatacccttatcatgtgattcctataatcaatatctttgacatattttactcccagtagttccccaattctgtatccggtttctgctaacataagtaacagaagctgatctcttcggttcgtacaggcctgtaaaattgtaataatctgattttcttttgctgttctcccacgatgttcctcttccttcagataggctttaaaagaatgattccgcagtaccttttttactcccacctgattaaccgctataatctggttatacgataaggttttgagacttccgtactgttcatattctgcctctataaataaatagaacctgaacacatcttttaagtatgcgttgcaggttccttcattcggacacttcttttctccagccgtttgctctgtatggtttccggctttaagccagtataaaaattccacaaagtgttctgtctgtttttcataatctaactgatagacttctgtgagttccatttctttctctgccatatatttcatataatagcagattgaaaatgctgtgcgtttcactgtatttggtgaacgtttacatttaatcttatgcattagatatttacttggcagttcttcaatactcattgtttccagatttctgatgaaaaaatatttttctgttccatcttttatcgtttccaccttgtatatcataagctgcctcctttcctctaacgctatacacagtatacccacttcatgccgaaatagctattcatcaataccaacaatctcaccgaaaacgcccttgaaataccaccaaacttttcgtgcaaaatctgctttttctgtagcagaaccacgaacggttacaggtagtattccacgccttttcggtttcggataaagtgctggacatccttgatatcttttgccatcttgcagctcggaagcgcacacatcacttcctcatgatacctgccgccttctcctgctcgctcgtctaaaatagacacgacacaagtatctgtttcggtgcggagcgcccgtccgaatccctgtcttagttttttctgcatgtctggaacgatcactgcctgaatgtagtctttcagattagcatattccttcttctgtgcttcgctaattggatcaggaacagcaaagggcagttttacaatgatcagcgaagataccatatctccagggaagtctactccttcccaacaggagccggctgcaaaaaggacagcattatccatctgtttaaatcttgtgatctcttccggggaatgtctccacacttctatcatcgggaacggaatttcatcccttaacatctggtaaacgtttcccatcaaatgataagacgtgaacagcaccagcgtatgtccgtaagtcgaacagatcagcgaatggatatgacctgctatcatctctgcctcttcctgacttcctcttctgcattttttcaaattctttggcagatataaaagacagttcttctgatattcaaatggggagtctgccacatattcccggactctccgtactccctgtagtcctgtcattttccgaatatgggaaaatccctgtccggtttttaaagttccgcttgtaagaatcgctcccattcctctgctccatagcatctggtccagatactgtggaatccgtctgctggatgcacacaatataatcctgtgatcatggtcctgcttcagatgcagtacatacttcttatcctgatagaaaaagcattccagcacacttctggtttcttccagcttgtttctgatccacttcggaatcttcttttctaatttctctatgatcttattcatggtctgtatcccctcatataaatacattgcacattcttctgtcatgtggaattcttcttttatcccatatctggttctgtggttttctcctatgatgtccagcaccatccggatcgtgccggacactttccttatctcagggccttggtactctttccccagataaaaacagatttcccggatatcgtcatagcacaggctcttgccgaacatctgctttgccgcatccggcagcttgtgtgcttcatcgacaatcaatgccctgtagtcttttaataacgggcggtaatcctgcagcctgtgataaccatcagccagcagataattgtgattgcaaatctgaatgaacatttcattatctctggaacgctccagatactgctgatacctgcacgagcctcttttcgggcagtctcccgaacagaacttcggtacattcaccagccttctgtcaaacccacttaagttggacacttcgtccatatcataatgttctttcaacgacagcagagcttctttctgcaacgcatttttgtttttctcttcgattgcaacgattcgttgctccagcctctcatcgcagacaaaatgctctttcccttttcgtatcacagctttaataggggcctgaatcgtcccgttctcctgaagaatccgggagagaaaagggatatattctgtaagaattgctttctggagtgcaatgctagaagtggatatcacgaccggacgctgctcataaagggaacatccttctgcaaggagggaatattttctcatcagaacacaggccaccagataagcatacgtcttgccgataccgacacccgcgtcacacagtgctatgtttcttcccagcaggttatccagcatttcgtggcataacataatctgttcttcccttactgccattccatgttctgggaacagcacacgaaagattgtatcaatttcacgatgcgctctttttaaatattcttttgtgtaatacataatttgttacctgatatgcgtgctgataccacatcaatacggctgtaaaggatttctccctacagccgcatgtatctgatatcaacgacacattcttccttgatttcttatacttttgttttttggcattgtatttgtcctcgactcccccattgccttacgggaacattacaggcggatgcttggcattgcaccgctcatggattttctaaaggtcttgctgattacaacccaaagtccatcctctgctcactggcagttcctatgtatcattatcccctcgtaagtgatcctcgcaaaagaccgccacgatcctgtttcagttaaagttgattcgctcgaaacaaaaacaccagcaaagaattttttgtattctttcctgccattttcatttgtcctcgcgccttcctgacacgcttctacttacgggaacgtacctgtaatgctggtataggattgtcaaagtacactggcaaaatttacctgcctattaaatagccgacgaaaaatgctgttattattcaattttcaacaaattatttaatttttttcttaaacggtttcttttggtataaacggtctgttctgccattcccataatttgggcaatctctcttcctgaatatccccatgtactaagcaaaagtatctctaatatctgatgttctgtgccctttaataattcatagatccgtcggtctccaatgttgtctaaaagttctcggatgtcctgtgcaaaccgtcctctgtccctttgttttatggaatctatatcctgcatcatttcatccagatgttcccggtatctgcgctcttccagaaaatcttccctgtccatctggcgcaacttttggatcttctcttcttccattcccagttcacgcagtttcttttcttcctgttctttccaataattccactttcgttcttcacttgtcttgttataagccatttatctttcctccgatctgatttttggtatataaatcaaatcggagcatggcggtgaccggatatgtacgttataatgtttaaaaaatatcaaagaaaaaaatgctgcaacctcttcgattacagcacttttttctctcttatgtgaatatttcttgttggttcataggagattccttctttttctcataatgaataaaagtctcttgtcatccattatttattataatttttctactattacaatagcttttttaacaaattttcttgtcttggagtttaaaagaaagctaccagttttttcttctgatagctttccattccttcttattctgttgggaacatcgctgcttccagcttactcgtctctgtatctgaaagaccatattttcctgaattatccttttccactgatacttttacagtaacagcttttccatatttgttcttttcaagactcttctggacgctttctgttaatacagatgcaaagacttccggatcatttccatccaatccctgctttattttttcattgcttacctctgtagagctttgttgcaatgtctgaaatacattggatggttcaacttgtacacttactgtatagactccatcctcttctttcacatcctgtactttgtattttgccagtttctttacttctgccagtttttttgcataatcagcaattcctttgtccgtaatgttatcggaatcatcaaattgctgttggatactctcattaaaatcctcttcgatttctttcttggcatctttttccgagatctctaacagattcgcatagtctttatattctccatgatagtatgcatcaagagaactttgaacgtaagatttggcatcgaagtctggttgttttgaacaagctgataacaatatacatactataattcctatacttatgcataaaacacaattcttcttttgcatattctctccttcgtattttattggtttgccaaaactaattgattatatggatttaataaattatcattaaaagctgaatttttccattctatacattccacatattttttcatttaattgcaaaattgcagtattttctccaattcttgttttgaaaatcctttaactaatatttcttcgcctttcatatcgcattttatcttcttaaaatattccaatgctttataaaaatccacatctcctaatggttctccctgaatgggtactaataatattctccatacttttacttcttgatcatcaacctttgctctaggtttactatgaaaaatcgtatctgtattttctgtaagtggaaatactccaaatatattattattaccagaataaaattttgcttctgctctatatgcatttttccaatttttatttaatcctcttaaaaacatatttttcttcctccatttcaaccagtaaaacttcacttttttgtaaattatcaaaaagtatcttctcaaatttttttccgtcatttacataatttcttccagatttataaaaagacacttctggtataaattccgttcttatacttaaatttataaattttgcaagctgatcaaaatcaactaaaatttgtggttctgggaaatcatgctccttattaaattcttcatattcttttataaaactcttgtgttctggcgtcttaatcttttcactcaatggggtatctttcaaaaatttcataactatatgatacaaaccatgtataaatattgccaccgtattacctaaagaccgaatgtttttatccattccataaatatgttcattaatccaattacattttcccattgactcacataattcttgtaatccgcaattaattccatctacatctttttgatataaatcatagaaaaattttgctaatttcaaatcaaattgagtgcgttttttccccataaatgcacttaattctgcttgtgctttatttcctacttcattatcatgataagtcacagcataaagcatattataaaaaggtgccgaataaccgcaagtagcaggtccctccttaaacggcataattttttccaacaaactataatcattacatgaataggcgattactacttctataaaattaattgtctgtgctccaccactattcgaacggttttgataaatacaattaaaacgattttcctgataaattcctttcaacatataattcatatcgccagttacaatagctttatttactccttcaaataaaattctgttttcacgcaacaaattaaaatacatattccaaaaatacccgtctgcttgtcccaattcaatttttttcgtaaattcatttattccatttttaacatcattccaaagcttatctgcactagattcacccattatcttttcatatttttgttgaaaactttttgcaccttttatcataacgtacccctttcttctccccagtgagatgttatatcccactgggtatgtaagacactttctaattatttaatactttaaaattcaaacttccattctttttaatattatacaaatttcgttcataattattaccaatgagattagctttttctgttcctaccgcctcttcaagacgcttaccacctatccatttcttagacatctgttttgttccatctttcagggtacttaatttactagtattatatttagcttcacccacaatgtactcgtttgttcctttattctgatatacaccatccaatccttgatgtccagcatcattaagacccgtaactctatcttgactgattctttcgaacccaatagaatcataatactgatccatcttcatttcagcataattccctttttgctgatttgtatactgcacaccatcttttattccattttcaaattttgttatctcttgtttttgcatttcttgagcttttattgtatcccaatgtttattatatcttgcagcttcatcagcatccattagttccgaaaaactattatatgccttgttatcttccagcaactggttattttgtgataagtctttggttgccatttcagtaatatgcccaggtttagtcgcacttgaacttccctttaccaaatctttcactgcaccaattgcttttcctgcaccataagtaagcccacctaaaataccaccagagattgctcctgtcaatccacctgttatggtatctttcgcaatctgtttcaagctgtttcctgacaatccagaacttattgcaccataggaagcaccaccaattgcaccagctacagctcctgaaaccattgctgttcctaaaccgcccattgctggcaatgctgccagaactgctccagctgctaaaccgcctgttgcagcaaccacaacacctgaaaccaccattgccgtcacaccaatcgctacattcttccagtttactttacccaactgatctgtaatacgatttgttgtcgtacacatatgtcgtaccacttctgagcggatttctgccgttctttctgaaacataggatttgaaagatgtataagtttttccaattttctgtaccccattgcttacagaacgaataaactgacttcctctggatgtgattttttgatatgtactgctactggttacacgatttttcacagattgatatgtctgttttgcatgtttagctgcatttttggcagtttttgctgcacccttcactgcgttaacaatagtttttgctgctttcttagctgtatttactactgttttgactacctttttcgcagtattaacgattttcttgccgacactcttgactgctttcgctgcttttttagctgtactcttaatcctgctccacaatgaatgtcctgtcggatcactgtaattcaacggattattggttgtataatcgtagcggtttctggttaatggattttctgtcgttcccaggtcactatcttcagttgtaaaggttccgttctctgcgttatagtatcttgcccgcagatactgaagtcctgtttttacatttgtggactctccattgtaaccgtaataattgactccatctgctgttcctgatgtaaggtttccatacgaatcgtactgataactgttcgtcaggttagcattttctgtcaggattccggttacgctgtttcttccgtcatataaataataactgctttcttccgatttatcaacgcttacccgttctccgattccactttctccataagtataagcctgacggactttctcgtctgctccatactctgcaaggacttctgtattttcacgattgatatcgttgatatactctgtcaatgtgtaacctttggcatttgaaccgccttttaccagagatgcaagctgttctttcgggctgtttccatcttcggtacgctggttctccggaatcaggacttcatcgccatagcaatcttcccatttataagtgttatccagttcgaatacccggttgttatctccatcgtacatggctgccatcaggactgttccaccctgttttactactgccagacgattttctgctgtatattcataagtgaccggatctgcactgtttgtcttatcacattcctggatcagattgccatctttatcatagctgtaggttgttcccggatcgccccagatctttgcattggtccgcttgatgagctggttggaatcattgtacttatagttatattttgctttgctgacaccatcttcgatcttctcgtaagaggtccggtttccaatcttgtcataagtataattatgaactgtctttttaccgccctctgctttttctgtacagcgtgtcagttcccagttgtcatcgtattcataggtacgtatcgtctggatctctttttcctgatgctcacagtctgctttgtctgtctctttctgtgtatcgccccagttgtaccagtcttcccagcttggcgtctttcttgttccagcttccagttccgtagctgtttctccaactacatatccctgatcattgtacttgtactcataagtactgattactttgccgcaggaaccacaggtattcacaatctttgtgatatgatcttctgcatcgtaagatacttccgtctttgttccattacttctagtaacttctgtcacacgattcagtgcatcatacttgtatgttgtcacctttccgttacggtctgttaattttacgaggttatcatttaagtcgtattcatagctgacctttgtaccatccggatacacgattgcctgcagattatctgcgtcatcataaacgtagctgacatcctttttcgaaccgcttgtcactttggtgattcttccgagtgcatcgtattcgtaactgctcttgcctgtctgatccttcatggatacccgttccccggcactgttatatgcgtaggtcacgtccttttcggaagtctcgccttttgcgtcctgataagatttctccaacaggtcattcagcttatcgtaatcatacgtggttttcttgccacttgcctgtgtatgtccggtcagtctgcctttttcatcatagtcgaatttctctgttcttcctgccggatctttgatggatgtcaggttgccttccagatcataagtataattcgttgtcttatttgctgcattggtgaaggtcaccaggttatccatgttgtcgtaaccgtaagttgttacaccgccaagggcatcggttactttggtcagattgtcattcttgtcatattccagacggctctttaatccggtcttatctgtaacaacctgaatattaccatgtgcatcgtaatcaaatcccgttgtgaatccacgcttgtctgtaatagaagttaccctgctgtccttatcataggtataggattccttctgacccagtgcatcggtctcttctgttacacgattgtctttatcgtagactgtctttgcaacatagcccatcgggtctgttacagatgtcacattataattcttgtcatatccatagctggtctttcttccacccggtttggtgatctcagtaatatttcctgccgggtcgtaagtataagcagttatcttaccaagcggatcggctgcagaagtcatctggcctgccaggtcataactgtaggtattgctccgtccaagtggatctgtctccttcaccagattgccatacttatcataagaaaagctggttgttccatccagtgcattggtagaagacttcatgttgtggagcttatcgtacgtataagttgtggtactctttaagctgtcgctttcttttaccacgttgtccactttatcataagcgaaattcttggtataacccagtggactggtcatactcttcagacgtccggctttatcataactgtaggtatactctccgccattcgcctgtgtcatctttgtgacattgtcattcaggtcaacactgtactgtgtctcatttccctttgcatccgttacagaaatgacattgccatgcttgtcgtaatcatatttggtaactgctccctttggagaaatctgttccgtcatgttactcaggctgtcatatttgtattcggtaatgagtcccatcggatcttttgatttggtaagattgccaatggcatcataacggtattcatttgtttcttttaacggagaagtctcaccgatcttgcggtccagttcatcatactggtaggttgtcgtatttccatttccgtctgtctgggatacgaggttgtcatttttatcgtaagtatacttggtaaccgtaccgttttcatcgacagattccatcacattatcatttccgtcatacttaaaggtgctggatgctcccagtggatttgtctgagagataacccggtctttcttatcgtaagcgtatttatatgtggcttcctcttcttctgtcatggataactggttgccgactttatcgtaggtaaaggttgttttatgaccttccgcatccgttaccgttgtaatgcggtccataacatcatattcataagatgtggtacttccgtctgcttcagtaagtttcaggagtctgccgtattgatcgtacttgtatgttgctgtcctgccaagttcatcggtctgtgtcagtacatttccggcaccatcataagtataatccatgctgtttccaccattgtcggaggaatggatcaggttgcctgctccgtcatactgataggtaatgacaagtccctgtgcatccgtacacttgataagctgtccgatggcatcatattccatctggactttatctcctgtcggaagtgtgatcaatgtgttatttccttcatggtcatacgcataaacatacgcattaccaagggcatctgtcatctttgtgctgttgccctgtgaatcgtattcgtaagtggtctttcctttcagggcgtccaccgtctgttccagattgtcggtggaatcatatttcattgctgtaatgttgccctttgcatcggttaccgatgtcatgtttccattaccatcgtaagtcatggtactggtatttccattttcatcggtagaggataccagatttccatttaagtcatacttcatggatacggtatatccaagggcatctttggatgtagtaagatttcctgccttgtcgtaagcataagtatctgttcttccctcttcatcggtagaagataccagatttcctgctttatcataagtatatgtggtagttccaccttctgggttggtttcacttaagcggtttcctgtattatcataggtataagtccaggttcttccactgtcatctgattttgataccagattgtctgccgcatcataagcgtaagtgataactgcacctaattcatctgtctctttagcgagccttccgcagttatcatattccttggaatggctgcttccatctccataggtaatctttgtttcatttcctaatgcgtcatattcatatttggttacattaccaactgcatctttggactgaagcacctgtccaagggaatcaaacttggatacggttgcatttccatttccgtcggtatattttttcagatttcctgctttgtcatattcatagagctttgttccaaaatctttattactctcttctatgacacgtcccatgctgtcatacttataagtaattgtatttccttttgcatcggttgctttgacctgctgataattcttatcataagcgtagctgatctgatttcctttcggatctgtaccactggtcatgttgtacatcttatcataagtataagtggtggtattccccagtgcatcagtacttgctgtaatatttcccacaccatccagtgtataagcggtcacaccgccatcggctgctgtcttggaagtcagattgccattcgcatcgtaactgttcgaggttacatgtccaagtggatctgtcatggtaactgcacgattcatcgcgtcatacgtgaatccccatgctgctccatttccatccacatatccggtcatgttcggtccgtcatacgaatacgttgttgtgacacctctgccgtctgtctgggataccatacgatgtttgtcatcgtaagtatgggtaatggctgttccatccggttttgtagatgtgaccatatttccattaccgtcataactgtaagtaaccgttgctccgttatatccagttgcactggtcagcttattctgctcattataagtataggaggctgtctttccatcctctcttgtctccgttgctacattaccaaatgcatcataagtgtaagtttttgttccggctgctgtcgtttcggaagcaagctgattttctgcattataagtcttttcacaggttgttccatccggatattcaatggaggtcgtgcggtactgatcatcataatgataaacggtcttatttccttcgttatccgttgttgtagtagaattctttccgtacttgaaagttgccgttcctttttctgcatcggtctgctctacgactcttccttctttatcgtaagtattctttacaaccgtattgccattctcatctttccagcttgtcatacggctgtcatcatcatactgatattcttttgttgttccattcgggtctgttacagataccagatttccctgctcatcatatttgtaagaaacttttccaccgtctggaagggacagttccttaatatgaccgaatttatcctgttttaccccaaacgtcttgccggatggtgtggtaatcttgctcagattataatcatcgtcataatctaatactgtcttaaatccattcacatccgttacatatcgtaagattccgtatttatcaaatgaccagacgctctgatccgcatctgtcagttcccatccgatgtagtcatggtctgtatctttatagctgactgtttttaaatcgtatacataaccatccggagcagtgtagtttccatcttcattcttatcaaagatcagataacttccgtcccctctcatatacagaaggtttccgtcctccatctgagaaagtgactggtcatagttaaagctccatccacgtccgaacatggaatgctggtctgttcctttggaattgtagcttcttgtaatggagaattccccattcagctcattcatcgtcgtatcggactgatccatatagaagttaccggtatttaaattgaccggctcaaatccaaattcacagtgcaggcctcttcccatcaatgctccgtcaatccgcatcttatcctgatcggtaagcggtgcaggactatatggaacatttgtctgtgggttacggataaaaatcgtattatttgcaactaccagtgcgtccatcacctgattgtctttcataatgttcttaagcggaacaccataatattttgcaatcttcgggaatgtatcaaactgcttcacttcataaatcacaaagctgtcactggtcacttcttttcccgtttccagtttgccatcgatttcttttgatgcttttgcttttattttatagagtttatcttttgtcagtcctgaatacaaagcactctgccagttggaatctttgctgtaatacttattcgcctccgggaactgcttattgtattccgtgctgtctggataggaatacaatggttttgcatctgtttcgtgatgctcttctttttcctcatctgggagcagataatactctactgtagatttgctctttgcaattccgtctgcaaatacggcatcaaatttcagttttccattggtattcttttctgtcatcgggcgaagcaggatcgttgtttcatccagtgacatatctcgcagatatggatcttcagccggtgaccactgaatactgagtttcggtccataaacggatgccctgttattcagtacctcacactgcatagaagctccaaggttatttgcctcggcaatggctaccagtgcaaatccgttattcgcatgagttccctgcacccagtcattaaccagatctttaacgtcataattgatatagctgttcctgctggtacttgcattctgtacatcctggaacgtaagatttactggttttgttttccatgtgatggaggtgttccacgactgatctacacgataaagtccaaactgggatgcaccaccactgtatgcagttttctgactgactgcaaatgttgcactgtcaattttggaatctttcggaatctgactaaaatttgaatttactttgatataagtccggcagttctggtgtgctgttccaaatcctgcaaggtttccagacttaataccatcatcaaatccaacatacggataattgttatctccaatctggctggttggacttccctcttccacaccaatcatgttaaaggaactcttctggatttccactggtgtcggatcgatcctgaccggatactgacgttcttctgccgaaagccaatccctgtctggttttacggtcaggattgtttttccctcttcttcccgaagttccaatgtgatcaggaaactgatttccccggcagcatcttccattgatggagtctccagaagatactttgcatctttgattgtcttcccttccggatagatatagacctgattgtcttttacttctgcctgataccccggaatctgcagctcgtattcatagacttccctgtctgttggctgctgaagtacgatatcttctttgatactggaatcaagtactgtatactgaacatctgcgccctcgtaaacttcattataaaggatcgcattatccttaataacagaatgtgtataatctccatctactggaatgattccgattctggtctttccattttcaatcgttacaccattctcttctgacatctgttccggaagaaggatggcataatcgtttgccttgttctgataaacttctgttttctcttccttttcctcagttgccactacactgctggcttcctgtgcttcttcggatgccggagtatctgcttcttctggttttacaagtgtattatcaaccagctcggtatctccatcctcattcttataagttccgacataacctccataaacggttgtatactgcttgtctcctgtcttataagtcttggaaatggcatcataatcgatcagttcaccttccggttcttccggaatcggatagtaatcctgaggttctttcaactccacttctttttcctgcggattttcttctgtttcttccgctggagttgtctgttcttcctgaatctctgtatcttctgatggcgtcgtttcattttgtacgtccgcatcagactgctgactcttatcttgttctccagatgtggaatctgttatcccggcttcctcttcagtcaaagcctctggtctggagaaatctgcattcttctgtacatcctcaatggcctcttttgcctgtacaaagataggttctgttccctgtagtgccatcaggagtgcaagtactaaggctatagccgactttcgaaatctcttcatagtctctttctccctcttgtaatctttttctataattccttaaaaaaataaccgctaccccaatgtcatttagttaacgtttaatagggagcgaattcttacagaacaaattacagatgggccttagtggaacagttttacagatatgtttacgatttactcatgaaggaaagcacgacaaaaagacagattgcaaatctgcctcaaaacggattataatgatgcaagtagccttgcccatatttcctgtttcacgtattcgggtttatatgcatggaaattactcagcccaatggtatatttcagtttcctgaatgaggattcaatgtttcatctggcattgtacaaggttttgatacgttccacagggaattcatcacgtggcagattggtcacgatgcactcgtatgtagaagtgctgatagggaagcgtagaatacggaaggacagctcatatgtatcataacttccatattcaatgtaatcgaaagcagctgcctgatcaacaaagcgtatgtaaccttctgtgtggatgtctgccaaaacttttttcgaatggctccggaccagtatgacgctgacatcaatatcgaaggattccgcatctggaaaattaaaattgccgaccagtcctttggaatggatatccttggtacggaacaggaaatactgtccctgttccacaacatgtgccatgttattataagagcaatagccgcggtcaccgatatagacattttttattccatccaaaacatcgtgccgggcaacagtagtagtctggtgatgagaaagccggagtgctgaaaaaagtgcaggtagagccatcggcagccaggaaacggtaatgcgaatccataaaggaagcgggcggcaattccatggaagcggaattaaagtgccggaatacagcttccagcgcatcaggtttaagctttgcgcgctgctggctgagagcagaagcggttggtatggaagaatccagtccccagaaatcaagcatttcaaccctggtggaagatgagccttgtgaaacgagaaaggaaataagtttctgggcagggatttttttgcttctcttgaaatcggaatcgggatggacagcatactgtgaaatatcagaaacaatgtgttccacagaagaaaaaaacagttctttgatttgttgatggatcatgatcatgtgcctccttgagaaagtgatataccactaattcaagggccgctctcgctacctcaacaaatttatcagtagcgagagcggccgcacattttgcaccctatgtcaaccctttgggtagcttttttgaaaaaatttgggttagacccacaattaggggctaaccctgtaacttaactaaatgacattgaccgctaccctcctttttttctgactttggcactactataatctaaaaaatcaaaaaattttcacaaatggtaaaaatgacccttgaggtggcaaaaatagacgaaatcggtcgaaaaaaatagtaagacaccatcgccttactatttttcatctaatttcatatataataatattttcacttgaaaggatttctccgtatggcagatctccatctgaccatgatacttttctactacaagtttcacattctgtaatcctattccatgtccttctttcctgcttttcgttgtcagataaattccattcctcacttttggtgtatcttttatgctattctcaatctggatattcatgattccttttccataatacatctgaaacgataatctccgttcgtctgaagctgccgccccacgaatggcattatccataagatttcccacaactatacttaggtcaaataattctttccctatatgattcggtatttccacagaaatctctggcttttcaattactgatttcacatcttccaaaatataattcagcagattattcatattacggttttctgtatataaatgatgacataaggctgttccggctatattctccatttgtttcagatacgatagaatctcttcatttcctcccgtttttgccattgcccctattgttgtaagatggtgcttgtaatcatgatgtatcttattcagcctgtcctgtgatttcatcatcatctccagttcttttgcatactggctcatctgaattttcatctcttcctgttttgctgtttcaatataacttttctgaacctcatcgtgcagatagaaaataaacacattgataaacagtaagaataatacaatcgtagaccgcacacctcttctgtctggcagcaatatcctgatacagactataatgctgatcaccgggacagaaagcatagcaagccaatgacggttctttatataataacttctctttacacctacttttctttcaataatgacttccagtaaaaagaatataaaatttcccattacaatagttcccggtcccatgtgatgatgcaccggatttcttgctaccgcataccgttgaaagaacacgattggaatcccatcacataaaattcccataatatataccataagtgtattccagacatgatgttgccagtctgcctgatatgccactgttataattaacagagctatcagctcaaagatcagatctccgtacatcgttccccactgcatgcttccccagcatgaaagcagatatgcacaaaaatatgcaaatagcttttgtgtatcctcattttttggatacaggatggtattgtaacggaacacagtataaatccagaataatttacttgtcagataagtgatcaaatggatattcataatcttttcttctccgtttgtaatagtctttccctgaccttcttgcgatttgctttactgatactgagacgtgtcttgtctttcataaccacgttgtcatattcgtaatgctccacgtgttccatattgatgagataggacttgtgaatcagtaagaaatattcttctgttacatccgctacatcctttaattttcctcgatattcatattctttttccgatgtcacgatatgtactctttttcccagactataaaaatacaggatcttgtcataagaaatcttgtggattccttttgtatccgtatattcaaatattttcttccgttcttttaacagttcccgtaattcacctatcacccggaaaagttcttcctctcggattggctttacaagaaaatcaaatggatgaatacggaataatttcatagcatattcctgatatgttgaaatataggtaatccgcagttcttttccataatttttctttcgtatctccgttccgatatcaattccattctcatgttccagacaaatatcaaggaataacatatcgtaggattcttcttccagcctgttaagaagctgctccgcagaatagtatatttctatagatatctgacagtcattcgctttcccataatggagcagcttctgttctaaccaattacataggatgatgtcatcatcacagattgcaagttctagcatattttcttaccctcagtctttcgtaacacgacaaatggggaaaagaatccccttcaattcttttcccgaatggacatcactaattttgtgtcatttttccgatgcaacagcaccacttcctttgctgtcttattttgtcctctatataataaacacttgaacaagaaaaaactgtcgccattttataatttatttatattttttatgttttatttatattttatccaaatattacagcgataactaataatgtcaccccctgcattattctttttatttttagcgtcatttgataaaacatcaacgtttttgatggcaaaaagggaacctgcaaaaccagattccctttaaaatacatgctcttctctaaaaggatgataaatccaccatcctctgcttatttttaaaaactttttccttttttacaatacttataaatattaaatggtttttcttttttttcaaataaaatccctgttgttttaataatttttataagttcatccgactccatatctgtcgttttaaatataaatattttcttttcatttgttatgaaaaaaaagaagtttttatataagaacattctatcaatatttttaaattcataaatttgatcttcatctattttaattgcgttttcatcgatatccaccgtttcatatcctgatctaccccagacaaattcatgaacatttttttcaaaatttttaccaatcatttgataccaaataatccaagccacacaagccacacaagttccaatccctattccaaacatcaaataactttccgacagataacaattaatcgacagtaaaaattctacaggtgtaaaaatatagataatcattctacttttctgtcttgttttaaataattgattaggaattataaacccaagcgaaagcattctttctaattcttccctatcctcatctgacacaattgatttaatatgcattcttcttaatcccccttttgccagaggtcctctttataaaatcgaacctctggccattgtctcttttattcttttacaatttacagcgcttgaatcaacaaaccaaaaacagtacctgctccagctgaaaataaagcaataattgacggaattgcatttacaactaatgcacccgcaagaactaatattacggctcctgccagtatattactatgctcttttgtgaattctacaacattaaattcaagaccactattagaatttaatgtcattgtaaaaatcaaagcaaccgatattgtccactctttttcctcttctggcagcaaatctgatgtactaaatacaatggaaaactctacactattggcaaaaacattatttatttcaaaagcaatattaccagatttaaccgataaagcaattttttctatcgtatttccaaagttatctgctccctctatacctgtatctgataaatttgatgaaatctccataatttgatttttgcaagtttgtgtcaattctccatcatttcctatatccacttttatattataaattttaccagttgaactttcaagcgatgtggatattttagtagaaatatcaattgctccttgaggactcatcattgttcccagtgaaatttccttatcatactccacacccacatccataattttattcagataaccaagcggctccattacattatagacatattgatttcgtgctatttttacctttgcccgaagattttcttgcgctatttcctcatctgtttttgtcgatacggcatcgaactttttaaatccagtatctctccctgaatatgcatctttatccagtgggaacgaaggtgatgaagaaaatgagttcaactcacaaaattgatcaaatgcccagttcttcggcatcgaatatcccaaattacagctaaatccagttgacatatctgccacaaatgatttacttgccaatcctgcttcataaactttagtacatacatatcttggtgcataaatgccgactttataatttttatcatttgtcgaactgaaaaagatcatgtgaatctgttcaaaataaggtataataaatgtatcaatctgatatgaataacaatcaaaatccactgcaaagtatatagtcgttccacttggtataccgattctctcggctgctaaaattgctgtctgtgcatcaacacttccctgggacggatccttaaaatagtttaattcatatcctccatcctgatatatcgggaataccgataatcctgcattttcaatgtttttcacttctgttgatgtcaaatatttcggtgtatgttcttttccaacagaacctgtcagataacgtcctacatgagtataccctgcattttttatatctaatgcctgttgtttatttaatactgttgcacagtcacacgcttttgctgccctgtttgtatcgcctttactcgtaagcaatgatttcatagtagaaacatttacttttccttttgttacaagtccaattcctgtcagaccataaaactcctgaaattctgacacctttgactctgtagtcgaatcaaacacgccatcgaatcttcccggattatatccgttaaaatatagtccgtattgagcaatcttattaaatggaacatatttcgtcgagttctgtccgttctgtaatgtacccggaaacgcatttgttgttgcatcgccaaaattaactgaattcaaatctgtaattaattcagttgtaactccttcagccgcctgcaatgcaccaactaaagacaaaattgtctgtcttgaggcaattccatcacaaggtccaacaccaataacatctgaccagtcactatttaattgctgttgaataagaacaatattggaatccccaccagaaacctttgtaaaccagtttagggataacaatccagaccaaactttccaatcaattttgcccgtaacttccagtcctgcattttcctgcatctttttaactgcatttactcctgatgtataataaattccagtaattcctccagcagcatatcctttgcaaaacagagcacactgaatcaagcatacattaacctgcggagtatcattcggatccatttttgtaataatggctaacttcttcatggtattaatagtaagtggtccaaccgttcctgtaatcgttgagattccattctgaatctgaaatgcacgaatgattccctgcatcacggctgttccggtctttccatcttcatccagttttacccaatccttatgtccaccaaacatcgcatttaaatatttttgtgctgcttttacattctgatcactcatattcactacctcctaattcaagtcaattataaagatttctaactctttatatgtctatcactaaaagttacaataacaatttatcaatcaactgtgcctattttgtgactattttccaaaggattcattaactcccttataaaatccttaacaaattatgaaagaaaccatcaatttatcaccccatatcccattatagaactgtaatctactgcataatttctctgccgtacctgatcactggaatttccctcaatcgtgtaaactcttccaccttcacacttttctactattcctacatgatccgatgttccatcatgatcccagtcaaaaaagatgatcattccagctgtcggagttgttccgccactctgccacttattctttccctgaaaccaggacactccatcactgcacaatgagaatttaggaacattcccacttgcaatcagaccgctctgatccgcacaccagcttacaaaacaggcacaccattctacccgactgtcaaatccgtaccagctccagaacttctgaccgccactgtttccaagctgccccattgcaaccgacacaatctgctgattaccaaacaaaccagcaaacaggctgccaccggaataataccgcatcacatggggaacgtattggggatctccgtaactgctccatccatgcgaagctgcctgttcctgtgaaaactgcaatgcattggcttctgtataaccgcctctttgcaatgcccatcctatgtagccatttccatagttatatccctgccatgcaagtttcagcttgtccagatcctgtggactgctgcatcctgcctgtctgatacagtctgcaaaggtctgtactccaacctctatcgaataatccggatcagtaatagaaccaggagtgtgtgggaatcttgtattatatggactttccgaacactgcatcgggtctgttcccctgcctccagattcctgcatcatgatggcctgtatcgcagacacatattccggaatgccgtattgggatgcatactgctgtatcacagaagtatacgcaagcacttcttcacttagggattcggagctttccgaattactgctgaaagctgctcctgcaatgattcccacaatcagaataaataccagaagaaatgcactacctccggcagcaatccattttcccattttttcaagagctactacccctttttgaatcgctgctgtaattccctgtacggataactttgaaccctttccagttacctgaaggactgcttttccactttctgccgatgcctgtgctgactttcttgccatctgggctgctcttgctttctgcatcgcctgaagacttttttccatctgctgtttctgcatggatgcctgtgtctttattttttcttgagacagaccggatacttttaccactctcggtgctgctttcacctgccgtttaccattctccttggcaagtgctgcctgctccggtttcaacttgattaatttctttccgctttctgccccctgctccattgcttcttcggcagctttcgcttcttcctgtctgctttttctttcctttatcttcctgtaggtcactccagcaagtttttttccaccttgatatgtggttttccctatactttttcctgccacactcgccgctctgtactgtacggattctattttttcagttccatactgtgttggggattctgactgcccactgcttttttcatgtagttcccttggcttttcttttgcttccagaaccgctgagcgaaccagttctttcggaagtcgggcagccggatttcgaatcttcggattcttatcccttacccgttccttgatatctttcatccggtcaccctctttccgtatctcttatctcatcgggcaacatcccgatgtttctttttttcctgctgtttctgcaactgctccacctgtctgattgcctcatttaccagtggatgttcgttgtaatatggcacaagttccaagtctcccctgtcttttgatgacaacggtaatggatattccatgtctgaataaattgattctggatcatgaatagaaaactcaatagccggacacatattggcagatgttctacaatatttctggtactttttatatgcctcttccagcgttctgcattttgtatattctcctaaatcatggaactcaccgcactctgcagcataaaaagttatcgttacttcttcttttttcttcattatgattctcccggttttgttgtcattagtttataaaggtctgtattctttgggaacgtattctcaaatggtacgatattcccagagcaacggattaggccactgccaaccgatacatttgtaatataggacagttggttttcggaaatattcaaaagagctgccaattcttccctgtctgtacttgcctgattcaaaagaatcaaaaactcactgtttgccaacatcagtcttgcagtgtccgatttcagaagttcctcaacattttgggttaaacctgtcacgaatccattgtattttctgattctcttgtacagtcggtagaagaaatttgcactgtattcatagcggaataacagatagaactcatcggcaaatatccatgtcgtttttccttctttccagttctgaattaccctgttgaaaatactgtctaaggtaaccagcattcccagtggcataagctgttcccccagttcccggatatcataatccatgatcctgttcttcttattcacattggtcggctgtgcaaaggtgttcaggcttccattgataaaaagttcggatgacagtgcaagtccccttgcctcttcttccggctgtaacatcaactgtcggtacatatctttcaatgtcggaacttctccggtataaccacttcggatataatcccggtacacatctgcagcacagcggtccaggattgacttttcttttgctgacaggtttcctgctccaaccaactgttcaaatacagacagaataaactccgatttttcaatcagtggattcttttcattgccgtaggctgcgtccatatccattgcattcaggtgattgtctgatgtcgcagatacttttacaacctgtccacccagagcctctactaattttgtgaattcggactccggatcaagaatcaggatatcgtcatcggtactcaatgccagatgcacaatctcttcttttgccgaaaagctctttcctgatccactgacgcccaaccggaaactgtttccattcatcagtttcttccggtcggctaccagaaggttcttgctgactgcattctgcccataatagataccgcccggctgcaggatttcctgtgtatggaacgggattaaaacagccgttgattccgttgtcaatgtacgcagggcattgatctttcgcagtccgtaaggaagcactgtattgagtccgtccacttgctgccactttaatgttgccatctggcacagatgctttcttgctatcgacaataataattccgtatcggaatccaactgttttttactgtctgccagatgtaccattgtcaaaattccgaacatcatacgctggtctctggttgtcagatcatcgagcatttccttggtttcttttctctgaagttccatatcgtatggtacgattgccgagaagttattattagcgttctgccttctctgccagttggtcacgttggtttccacaccaagcagtcggttctggatttcccttaccgcttcatccgtagggactggcaggatatcaatcgacaatatcagattccggctgaagtcacacagttctgaaatcatgtcatctttaacataacttgcataatcctgcatatacaggactcttccgtacctgtcaccgattttaaaatggtcacgttcaaattccatagaatccggacacatccagtccttgaaacttgttcccttcttggcaaattgtttcagatcaaacggaaatgcctgtgggacatctcccttgaagaagtccctgaaaatctggagccggctctctgcgtccagtccttctgctgtggacgataactttgccagatgtgttacgatgtctgttccgatacgtgcaaaataggttcttgcatcgtcaatcgatcttttatgtacactgacagtcagataccgttcctgatagatgctgttgtttgttcctgtaatcttagacaggagcatttcgttgtattcttcccgatagtggtccagtccatcttccttcattggaagcaggattgatttttcaaattcttctttattgattctccggttattgatggtaattttggcagaaatgccggaatccagtgaatttaagagttcggaataatccagaaacatttctgtcttattgtccttactcgcaatataatagttgatatctgtaaaacgatatgtttttgagaatttcgttccctgttgaaaaattccatccggccagattcgctggatgggaattgcctgttggactgatttcggaactttgaagcgttccttatccatccgaagtgcctgacttaaggttttaatcaaaggcatcactccttcccttgcgtttctttctctgttttgcttctgctctttgctcccgctcttttatgatttccgctccatccttttgattcttttctcccagcgagatggtctcctgcatgcaggagtagtggatatcttccgactgaaacaccagtttcttcggatacagcaattcggatttgatcactgcccataaaaactgttcggctgtcataccatgatatttgaaaaagccacaggcagcaaatggagtagcaccaagcacacacagccatccggttatttcctgtccggtaatttcacgcattccaaagtaaattccgattgctgtaagaatcgcaagaacagaacacacacattgtctcaggtccagtcccataaacatggattcctgatagtcccggatttctttattcatcttgacttccataacttatcgctcctttcctctgctttgtttcttcgttttctgtggtttttctttcggtacttctatcccggcaaatctacagtgttctgcaacgccttccggatcaaattccgcaagtcttgctagatcaaacgctaccttctgataggttgcatatcctgatcttcctgtttcattcaacacttttcctagtttatgttccttgataaaatgaagcatatccttggtaaaatctcctgttataaaagcctcatttggctctaagaactgatagggcagattaatggttacatctccaaaatcttcccattctctcccttccttatggcagagtcctacatataaatttccattgttccgataagagctcactcgtattgctactgtctcacgtccaaattcccagttatatcttaatgttttctttatatccatatttttaacctccaagtcccatcatttctctgacaatacggtcagatgccttaattgctccaaccagcaccagtaaattaaataccagttctccgacatagttccacacgattgtaactgcactcaactccgtatctccgacagccggagggcttgctgcataagcagaaaagataatacatgccagtgcaataattgccccttccagacatacgcctacataagaacggataaagttctttccaatggactgcgtgggttctcctgcaaatgaggaaatcggaatcggggcgattgccgtatacatatagattttgaacattctgccatacactgtcaggatcattacaaatgacaatacagtgatcagcagactgccaagcagtgtaacaatccacaacggaatggattccagcattcccacgctctcaatcttatctacaatctccgttggcagttccgtcacgcttcctgccatactggagccactcattacggttgtcacgattccctgcacaatggaaaacagtgcctgcataagttccatcccgtatgtaattgctccctgagcaagtgcaaaccggataaatgcttttagcacatgttccggctttttcagatctgtaaaactgccacacgttttaatgattccggctgcgaaaaataataccagtaatccataagcaatggctgtcagtgcatcattaatatttaccataatccgccagatgccgccgcccttaaaagttgccggattttcggtcagcagagtccacagttctgccatcttttcactccatgtggatagtgctgagtttagattctgtacaatccagttatcactcaaaaactctcacctccttaaacatatttttgaatacaggagtaccttccggcactcctgctgtttcctgatatattttttcaaagaggcttacgccataatcaaatcgaggatttctttggcgaacgtaataattacccctccggccagtgtcagaaatccatttgccctctggcttggatcatggctttttaaagacagaccaacctgcacaacaccaaatccaagcaaaatcaaaccgatcgcacgaatcagagaaaaaataaaggtagacaggttattgataacggacaacggatctccggctgcgaatgcggtcgttgctccaaccgttacggtcagtaccagtgccatataaaggctcatccactttttctgttttctccccatcggcatcggggttatcattttttcagttgtattcttttttgttctatttttttctcctgtgagaagtttcttcaatacacatcactccaatccatcaaaaaactgctattcaccaaggatgtcctcggtagacagcagttcgtaatcgtctaatctgttaatgtcaatctttaggtcgtcgtgagccagtggtgttttcgcataatcataaggcgatgcaccaccgtcctctgtgtatctgaaattcacatgcttttttaaatcatatttatcgtccatgatcggacgctccccacgaataaacaaaatcgctttgcggttatctaaaagccgtatttcatccggtgttaaaagttcccttcctgtctgctgataattcaccgaatagctgccgctacgcccttttgtctgtccgtaggtattggtatccaatgtctcttttcccaataattccgagacatacttatgtccttctttttcatttccacccagatataaaaattcatcgcagttgccgatcagactctcatacgagtctttaaataaggctttcatctgtgcaatgttctggatgatgatactgcaggaaatccctctggaacgcatggttgccagaatcttgtcaaaatcatccggcaaggctacgtttggccattcatccataatgcagtgtaccggaatcggaagccttcctccgtacttccgatctgccacataatacagtgtctgaaacagattactgtaaatcatgccgaccagataattcatgctggtgtctgcatccggaatacagcaaaacagtgctacttttttctccccaatactgtataagtccagttcgtccgtacaggtcaggttggcgatttgtttcagattgaacgctgccagacggacaccaaccgatatcaaaatagactttgcggtctttccagtaacaaaatgtcaatagttttttaatcacttttttcaaaaaagcaaaaaaatagaacgtatagtttatttccatacgctctatctcacatttcatattaaatttttaaattccacaactgtagtttagctatcaaataaattatattttcgttgaacatacctttcaataaaaaacgcttgcatcgagtcttcatctgctttcttatgatgaacaacaagtatcatattactcatttcatattcttctttattacttttcatgaataggcgtccaaatctacgttcattttctttctcatcgtgtaatgaaatatctggattattataattagtttttccgccaataagaccatatgttttatttgtctttttttcaataaagaatttaatataagtaaaaaatttagtttccctgtctttatcttgatcttgacgaatttgactccattttttataaattgacatattgtattgtttgacttggtctccaaaaatttttatgagatcttcttgtatagaatcgaatgtataaaattcaaactgaagggttagtccagcagcttcaacatcaaaaactttactttccatcatttcctcctgattatttactgttagataaatgcccgatttgttactcacatggtatcatattttttcttcaattacatccacctaattttaatacactgccattcggcttgcttctgtaaccagcatccggttaattttctcctgcattgtttcctttgcatcttcattgaaatgataacggacaacatagactgtctgcccgattttctttgtaaatgtgttcccctctgtttttgtattcatcattttttccataatcattttttcctttccttttgaatcaccggcagagagtcattccattggtctctgtcaggacattattctttcaatcaggccccaaatgggcacttccagtttcgcaggctacctatatatagccttttcatttttgcttgcaaaaagccttgtgatcacagcacttttttaacgtaaaaagcgttttaatatgatgcagtcaacgacaagaagcatacctaacaaatgtcattgtctatcacttctgttttctctgccgatattgctctggttaatgcctaatattcttccctgccaggcaagacgataagtacggcgtatgcttttatcgtgttgttatactgagaagcccgacaaggagtaggcacttaaaggttattttcaggcactttataggcattaaataggcacttagaaatacctgtttttccagtgtttatcatgctttaggcacttaggcactttatttttaaattaataagaaaaaaacatatacttataaaacccatatatttaagcaggatatatttcaggcttttctagtgcctaatgccttttccagccggatcaataattgacgtctttcgtcctcaccttgacatggacaccacgaaatccccggcaaaaacgaccgtttcctactgagatattcttatcataagtcattccataatcagctgaccgctccttaaatctccttgcaaaggatctttcgcttacgggtacatccaagttatcattgcaccatctgcaataagcaacatataaatctttagatgtggcatgagtgcctttttccagtccgatgtatccggttgattccagaaacgataggatattatcatcatcctcccgcatttcattcatcaataactgggatttattactgatcgtaaactgataatcgttacggatcagtctctccaatccctcaatgcaccatagaactatgccttccacttcttccatcatcttgtctgccaaatagggatcattgattctatccggcggtacatcttttgtttccagaataatctgacgtctgtaaaaaccttgactcctgtcaaaaagcgactttaatgtgccgtttccaaatgccagtattctgcaaacaagaagtccctgatagctttgtttgttttttttctctaaatccatttcgtcctcagctgtgacaattgctttaatcacattcgttgatggtaatgcttctgttttcatatcatcatccagatacaacagcttgccttcctgatcggctctggcaaatttgtcagtttccagtttctgaaggcttcccgaattcatgttatgaccaaatattctttttaagattctgccaatacggctttttccttcaccgccttttccgataatcaacagcatcttctgacctctattgctgggaatgagacaatatcccataaactcctgcaggcagacaatatcatccgcttcgagcagtccgtccaggaatgccagccatttttcaggtttaggtgcatccttgttataattgaccgtcaatcggttttgcgtccattctttctggttgataaacttctgatttacaaaataggttccattcttaaaatgaaccctatcctcttttatggaaagcggatctgaacgggtatacatcttaaatccacttaaaatagccgttactttagctgaaattccgcttgtccaatagtgctcaataatgttcagaatctttttctccatctcatcgtttgggattgaacgatctatatcatacaatattccattgatacacttgatttcatgttgctgcagaattgtctgatacagaaggatttcattgatctgcttgccatcgaaccaaatcggcagttccattttcggcaaattcttttccacctgtgtctcttcggttacttcttcaactttctgtaacgcttccagacgtgcaaccacatcgcccggaagattcttccttaattcgttgctcaatgttctttacctcctcctgacagtccagaatcaatcttgcacgatcttccagcgaaccactgagaagcacatccatcttgtattcaataagcgtatatttttccatcgcttcaacaaataacggatgccaatcatcatcttcaattctgggagcatactcaactttccatttctttaaaagatggaagtagtcactgtatactcgaaaaaaacgaatctgttgctcgtgaaagaattgatccagtgtctgtttcttttgttttggtttttgataatctttcgtcttgttataactctggtatttttcataaggtacagaaaaatcctctgccagtttttcagctgactcttttacagaaagattgaaatatttagcgacaaaatcaatcacatctccatctgcctgacaggcaaaacaatgatatcttttatcaagcttcatgcttggattcttgtccggatggaacgggcagacagccattccgtttcgtccaactttgattccataatattctgcagcacttcttgcagtaacagcttccttaacagcttcaaataatttcatacctgctcctttccgagaaaacaaaaagcactcgcattgattcaataacgaatacaatggaatgctcttatctgtcatctctattccatgattttttcaaatcattctttttatttgcttctctttctgccagctcttttttcttttctgctagacggctcatgatcgacggtctggctttttctttgatttcatttacaaccttaacttttgtttttggctgcagtaacgaatcttttactgtttgaactgccgtcatagctttcatgattttttttattacgccatccaaacgattttttgcataattcttttctttctccgaagctttgcgttgtggctggtcgatccaattctttgtgccttcaataagttgaatatcatcttgccgggttttaatcatcacttcgtttgtaacttcttccacagctttctcataagcaacatctgaaacatcctgcaataaagattcaatatcatcaatctcaagagtaagcttctctaactggtttttctgttcttctattagatctccctgtttgaaaatacggtctgaattatttgcaaattctgtatcctgctgttttattttttcttcctgtgactgaataatttcttcatttgcacgcacataccttgactgttttgcaagctccagacgattttcgtttaccttatcaatctgcataagaattgtttcctgttgatccgcaatttcttctttctgcttcatacggatataatcttgtttttccaaatactttcttccaccatacgatggttcttcatcaagttccagtccgtgacgtttacagatatctaaaaacattgtccggcaggcagaatcaaaagcaaccttgcggttatttgtctttgatctcttcttttctggatctggaagttcaaagccaagttcttccagtgctgtttcctgtttcggctcaatttctccatatcggtttgtagcatcaaaaacatgacgctcatgaatatgaggtgttgcttcgtccatgtgcagcgaccaatcaatgatatgtacgttagagccaaaacgctcatcgaactctttcttaaattcgtcaaatactaaaatcagggtttccacagaagcatgttcatctattgttccaagctgatagatactttcttccggacaggtctttttgtttttccaaacatcttccacttctttgcatctgtctgggtgtctggctttcacatgtctctcattttgcttcataacataatttccataatgctcttcatagaatgccagctcaatttgttcaaaagaaaaattattctcttttcccttatcttccattgtggtatatccctgatagcagtcccagtaaatattttgccggactctttcattgtcgatatgctcactgtgttccggattaaatctgcgatcattatgaagcggattgtaaactccattttttccagatctgccgttatgccttgttcctttcatttcacttttctcctttctttcaagttgtttccccgaagggattgcagcgaagctgcttaaaggctctgtcaccgttacagatagtacccagtactatatggcgaaacgccatatcactgggcaatggctgccgcccttaacctgctaagggctttgccccttaaccccagcaaggtgttgccaccctttgcattccaggcacaaaggacttccagccctctgtactcccggcagacaaaacgaaactcctgccactgtcccttcggcatgttttccgttctgcctgtttttcaaaaatcctctatttcggattttgtgaaaataaaaaagccgacgcaatttcaacttatacaaaagtccaaatacatcggctcaatcctttgacctgatcggtcattattcattttttccgactgactcatacagtctatttttaataatgagcaaaacaaaaggcattaacttttttacggttaatgccctttgggttgatcattattgaaataaactttttttcacagtttcacttacaacatctatcaaaagttgtctcatcgaattttttaatatatcccctgcacactttatgcccttcttatattttgcaatagctattggtgtcgccggagtttcggtgataagatctggaatagcagtttttattaactctttcatcgactcatccaattcatcttctaacgaaactaacattactgcattatctaaaataatttttgtccaaggatatggtgctccgcaattatagcaatagtccggtctgttgtaactccctgacaaatcaacaatcccatctacttcgtattttccatgaatcggagaattacactcaggacatttcgaatatgtttcttttccacatttggaacaaaatttttgataatttgcttgatatttactaacaacatgaccatttaaacaaatcgtagcattattatagtgtcccatttttattcctccacttcaacaaaatcttcttccattttcaaatcaaaaatagtttcttctataacttgtacacactcatcagtattcttcaaaatgtcttttccccaaaatcttataacagtccaaccttcaaacaataactgtttttcaatttctatatcccgttctttgtttcttgatattttctttatccaatagtcactgttttttgctttttgcaatctcggtttgagtacttcccaatcttttccatgaaaaaattcgctgtcacagaatattacaattttatacttagttaaaacgatatctggctttcccggtagcttttgataattttttctatatctgtagcctttactccataatgcttttctcaacgcaagttctatttttgtatccttgctttttatgttctgcatatttttctttctttgttcagctgtcagattatctgccattctatcaaccttctgtatttttacttaattgcttctaaaatactttcagcaattcgatttatgactggcacgcaaactgaattacctgcctgcttgtatagacgagcgtcactttgttttttcggaagtttataatcttttggaaatccctgcgtattaaagcattctctcggtgtcatttttcgtaatccatatttggttttcacaatacatacattatgaccaccttccccttgattagcagtgagcgtagggactactccacttttattctgtcgtacatattttcttctccactgataaatagctgggtgatttatgtcttcatcctttgtcgcttcaaccaacaatttataaatatcccctttatattttccttctgtataataatatttgtcatctacttttccgtcaaagtcaataatatctttaacagttgttgttaatggaattgacagcggccaatgaaatttattaagatcttcttcatctttaaaggcaacaatataaatacgttccctgttctgagccatatttccataattcatcgcattcaacacttgataggtataatgatatcccaataaatccagctgttcacatattaccctaaacgtgtttccattatcatgtccaactaagtttttaacattttcaaataatgcaactcttggtttgtttgcttcgaccatacgcataagctcaaagaaaagttctcctcttcccttcttatcctcaaatccttgtctatatcctgcaatggaaaatgcctgacaaggaaaaccaccaataataacatctgttttgggaacgtcttcaacaggaactaagtgaatatctctttgatcgactttaacagtcggataattcatttcaaatgtttcactggcatatgaatcaaactcatttgcatatacggtcttaaattctcctgtttcttcaaatcctaaatctattccacctacacctgcaaaaaatgaagctacactaaacattatctttctccttgctctttcgtaatgtgtacatattatcatatattgcggcgcgccgcaatattctattttgaaaaggcagagataaaacactctgcctttcatattatttaccgattaatctttggtagtattctgatagtctgtcataagccttacatcttcgaatatcaaaaataatgtctggctctaaattgtttgcatccacaaataatgttttaagacttacatgtggtcgtcttccctgatttttttgttcttgtattgtctgagttttatttgctggatattttccaaattcttccgaatttatattcaagtcataaatgtatagcaaattatcatctagcttaaatctcagaaacaccaaatcatcaaatacacattttggtccaaatgaagacaaatctccttcaaatcgggaagttgctttaaattcaatttttcttcctgtatttggatcagtagcgtcgcctacttcatcaccgcgattccacaaatatcccatacaataacaacccattggttcgcttattgcatcaggcatgtttatacctctatgactgttattagaaatatatgtgttcaaatctttccatttaaaataggcattgcaagtttcatcaattctggcatcatctattgtgatatagccaaattcattatatattgccatattacctgtgttagagtgttctatctctgcacataagaattatagcatatataaatcattttttccttaattacttgattacgataatgactgccactgtctttactcccgctattgaatcattccgttcacacttatcacaccgtcaatgcatccagcatgacttgaattacttctttcaacatcaatccatctcttaatcccatacggtaatagaattcattcagatcactgcatttatttgatgtttcagtcatgtaatcaaataaaattgttctctgtttgtctgaaagtttctgaaatatcttttgcaatttcatttccaatttttcattaaatggatcatattgctgtccgtctttttcttgatagacctgctccattctttctccgataagatcattcataaattcttccatttttcctgttaattccatctttttaatctcccatcaatatgattttgattgtttccagccacacaacaaaccaacttgcaatgataggtagcacatacagtaagaaccccaccgcaagcatcctaatcatctctgtgcctgtttcctgcccgaatccatatcccaatatagctgtgatacagataatcccagacaggatatgaaatacagttgcggacagccatgtaatgaacatgaccaccagctgtacgattgtcaggcttatacgcactggcaataacagaatccttataatgagttttacaactaccatgactgtccacccctttcactgtttcagataactacgatagctgtctatcacagaatctgtcacaccgcttttgtaaatctttcggatatcaacgattttttcatctttcaaaagtttcagccagtccagtaaatcttttctgctgtttgcaaaattacaacatcttccgtctgcatattcaatccagtatctcataagtccctcctacacatacaccagttcatttaaaataatttcatctacccggcttcttgcattgtttgcccggcgaacccattccatctgatctctgcttttcaattcttccgtaatgccttcctgctccataatctgttccatgaggaaatccctgcgttccaaacactgctcattcagatctgcgagatacgtccagagcttaccactcaatgtcagataggaatacaagccactcttgtaatctttcagatagtttctgtgaagacttccataaaaaccaatctctcttttctcttcgggtactgcgatcagtggcagatagatttccccgacaaggatataatccagaccattactgttatcgtgaatgattctttctaatttgctcatgctgatgcaactcctttcttcggttctgctgggggaagcagtgatagcggaatgaacacaccttttgcaatatcttcctgccggatctcttctttttttgcatccagttcggctttcttttttgcctttgtccgttcatagtattcctgctgctttccatttgcttttcttctcagataattctggtgaagcctgtcttttctggcttcccgtttttccatttcttcaatttcttccggtgtcattttcacctcaccgaaatgtggcggtaaatatctgccgatgaagttaaaatagatttccacttcctgtgtcgtctcaacgcttcctttccggtcacgctcatgcaccacaatcttttctacaaattcattcagcatgtaagtggtcaattcctcaaaattttggtatttatcaaccagagcaataaacttctccgctgatctgcgaccttcttcatagcctgataattcagcttccatatctgcaatttctgccgacaaatctttctgttctttagaatactgtccatcaagaatcgcatagcgttcatctggcagcttgccaagaatattgtcctcataaattctgcagatcagtttttccagttcctgcacacgcttttttgcctctgccaatctgcttttcaatcttgtgatctcactggactgctgtgaagtctgtgccttttttactgtctccaaaaattcttcacgattcaactgtgaatactccgcaacagcctttaaaagttccttaatcagctccataaccacatcagcattaattctgtgctgtgtctggcagagtgttccaaccggaactttagaatatgcagaacaagtatattgtggtacttgcttgccattatttactcgatggacatacattttggaaccacagtctgcacaatacatcagacctgtcaaggggtgggcttctccccatccatctgggtaccttctcacattgcttcggattctctgcacattgtcaaaagtttcctgatctatgattgcttcctgcgtgttctcaaacaccgtccagttatcctcagatacataatggcttttcttatccttgaaatgttttctggtcttgaagttcactgtatgaccaagatactctcttttcttcagaatacctgcaacagtagaagagccccagccataaggatctttgatttcttctactctgcctttccataatccggcatctttctttgccatatgaaccgctggtatctcaaccttatcctctttcagtgccttggcaatctgatatggtccgtacccgtccattgtcatgtgaaagattctccgtacaactacagctgcttcttcatcaacaatccatacattcggatcatccttgtctttcagatatccatacggtgttgtacttgccacatgcttgccggattttcctttcgccttgaaagttgattttatctttttactggtatcccttgcataccattcattcatgatatttcggaatggagtaaaatcatcgtcctcccggaagctgtctacattctcgttgactgcaatcaggcggacattcttctgtcgcagcaattccatatattgtccgactttcagataatctcttcccattcggctcatatctttaatcagaatcgttccgactttccctgactccacttctttcatcatggcaaggaaacctggacgatcaaatcttgtgccggagataccatcatcagtaaaatgaacaagattggtaaatccatgttcttttgcatattgttccaacagtttcttctggttcgaaatactgttggattctccgtttaattcatcatcacgactaagacgttcatacaacgctgtcatgaatccttgtttctctgtcatagtcagatgttctccttccttcgtttattaaattcctgttctcatcccatatccgttcctgtaccgggtgctgatgtttccgggacgtattaaccagaaaagacacgctgaatgcctattcagttctggtatcactacgggcaggctgtttcgttttcaaggttcgtgtaagaagtaaaaaaaagattcttacactaaacgaaatgctcagagggctttttacagcccccttactgcatcttttttgatttcgtgtcatctttttaaagttccttacacaatctctgtactggcgaaacaaaatacggacatgttttgaaattgttttttacaaaatacaattttggtctttaaggtaaaaaaataagcctcaagagactttttaatcattttggagctccaactctttaaaattgattgattaagaagtctcttcaaacttactacaccggccgcctgcttataaatggcatactgcttgaccgcaatactctctgggtcccgcatttccagtctttcaaacaaaatgtccaatggtgactggtaatcctcatcatcttctttgacctgtgcgcttccaagcatttccataatcatcgggaagttctgttcttccggtggagcttcatgcagtaaatacagcataagtgcctgtaaaagtgcagtctctgacttttcccagaacgggtccgagctttgtgcacctttcggtgtcgtgttgcggatcaggttgttaattagtttcagcacatccttgtcatcccggacatacgcaaacggattataacaccaggaagtctccggattgatcaaatcaaaaacccggacttcatatccattccgttccagaacacctcctgttttgcgcagaagttccgctttcggatctgtgatcaccatcgagcagttgcactgcatgatgttcggaatcgcataggtccggctctttcctgccccggaacctccgactaccagcacatttaaatttcgtttatgcttatatccatccagtcccatgcggaaatgctgtgtcagaagcagattattcgtgtactgcttttcgcagtaacgtctgcagatttcggacacgttgccccattttgcggaaccatgttccacgcctcttctataatttcttttttgggattcataaataccaatgcctaagaaataggctgctgtgaatatcagaatacatttgaacgtatacggtgtatacgtgataaaaaacggctgttcgagtttttcgctcagcgtttctaagatttgaataaaattcttatccggtgtaatggcacaagcggtaatcgctgccgcccaccagacaaatggcagaaagacaagatacagaacccagtcctgcttttttgtacttatctctgcaagtcagattctcttttcttgcgtggcttttcttctggatgtccctgtccttctttcttatgaaaggaatccactcccggtatcagtgagagacttctgccgttgtcccacttaacaccaagctggcctgcatcatccacatactgcacagttccttccagtccctgcggcatacccgcttctccatccatcgaattcagacagattcttgttcctgccggatactgttctctaagtcttgccactttttctcttgaataaatgaccaatcaaccactcctttctctaccagaacatgtgtctgctagtattcggttttgcaacctgaataataactttatctattccatcactgtatcttccggctgcaagatatttacttctgagtctgttcagtgccttacggatctgcctttgttccccggctgtaatctgcagtcgtttctgagcgaggtcgtattcacttacttttttcagaagagctttcgtttcttccaaacattcatcctgctcactctgcgcctgtagctcatcattcagtgccaccacgaacatatttttcataatgttatccatcttcaaatagtattttgtcatctggctgacctccttttttgttacaccaaccatatcacaagacctccgtaatagctactccaaccgtccaactttttcacttttatcgttccggctggttctttgcttttttctcttttccagatgctttttcatccttggtttccggtgtttttacagggtctccgattgcgaactcatcggttacatactcctgttcctttgcaccaaaattccgttcgatatggtttcggatactataggaagcctgacggacatcatttaaaaagtctctcagttcctgtggatctttctttccacattcatttctctgtgcaatatactccagattgaatccggtaacatccacaccataacgtttcgcaatcacataggctgcacaataagcctgtgcactgactttctgtcggctgtaggttccggtatgctggtccagtgctgcacacgccagttctctgttcagtgcatggaatgtcgttacttcactcattccgttgcggatataaatggtacggtatctcggattgtactgggcctgcactttgtctggcagatcatcctcaatctgcacacgtaccgactggtcttttaagacagttcctatcagttctgtcagacttcgctgagggcgttcttccaatggctttccagacatctgactgatgtcaaatccttttccaatcgtataccctctccgcatttctccgtctttttcgtattcagtggaaatcatataagtaatgccatgttccccgactttgaccgaacggtgttcttctctccagcgttcataagaccttaccaccttaaaatctggatgctgtccgtaaatcaaaagcagattcggtgttctctgggtattacactctgccataaagtccagaaagcctttcagtttttctccatcctgaaaaactccctgtgcctgtgaatctacttcagcccatacctcttctctttcctgctgttttttggctgcatattcttctttcgtcaatttctgttcaggaacctgctgttcttccgttccccctgaaatcatatctgttaaatccatatacattacctgcctttcgttttcatattcttacgtttcttccggctctctctggcatttttccgtctgtccggcctcttacgtttctcttcctgttccttgcggatatctccgagttctttccgcacagatggtttttcattcttttctttccagctaatttcccgatcggaagaagtatttctgttgcgcgagaaaggttcggatggattcttttcttccccctcctgcgcctgtgtaaaatttccttccgggaaagcctcatccccgatctggaacatttcttccgcatcgtccagttcaaattctatcttgccttccggcaggacaacggtctctgtccgtacattctccccggtttctttttccatctggttttctgccttttccggtgcagtctctttttccactgcttccgtaaccatagagcctgattctgcttttacaaaatccagattcatccggtctaatacccgattcatcttcgctgcatcatctgcaaataccatgacctctgtctggtccggattcaccttatctttgatgactacatataagatacctctcgccttggcttcttttgcaaattcttttaaacggtcacccggaacggtaaaaaatttcatcgggcgctgttcctttaacattctggtaagtcttgttttccctcttgtctttttctggtccttcaaggcggcagcaataaagactgccacatgctttgctacattcccggtgatcttcagcgaatactccatcccttccagactgtaccgtaccacctgatctgccggttctgctccgtaattcatacttatctcacctcctgacttttctgcattctttctttatcttccacacgtttttcattctggctctgttcttccgcttcctgaagtctcgcttcgatttccaaggaatgtttctcaatctgaacggtcatacgaacttccttacggagtcgcttcaattcctcattgatttcggacaatcgttcttccccagtctccctgcccccattccgatacaatcttctgcgttctttcataagttccgcaatctgcttttgcaatggctctcggtacgcggcaagctgctctctggttatgatgtcatgtttcagtagaaattcaatctgttcaatcctgcggtccagtttccggatatcctctctgacagcgtatggactccttttcggtctttttggcagtacccccatttgatataaataggaataatacagtgcctgaatcccggtcagtttctttttgggatgaatctgtactgccttttgatagactcgtttcacctttggctgtagtatctgcccacgtatttcctcttcggaatagttttttccgagagaacgcagacggatataccgctccattcccggagcttttaaagaaatgtatttcctgttcagtttccatgtataaccccgcttttccatctcttttaggaattgtaaccaggagtagctttcctgtaccgattccctgatatccaaacggatcgccattctccatgtcggttttccttcctgttctgctttccactgtacataagggattgattttttctgattggattcaatgatagacagaccatattttctgcacaggtcatcggaaatcttacggatctccgtataataactcttagcattactatggtacttatgtccgtccaccatgcttacagaattccagacaatatgattatgatagtgtctgctattaagatgtgttgttatgactacttcaaactgtccttttaagagccggtctgccagttcctgcccgatgagatgtgccagttccggtgtcacctcaccttctgcaaaactctgtaccagatggtatccttccacaccgcccatcttatggaatctctttttcgttgtcagcatatcttcatacgcattttcattggtgcatccgatggtatcttcgaagaccgcttgttccgtctttgtccggttcatggcataatcaatggcagcctccagagagtctgctttctgtgtggttttttctttgtctttcacatattcgatggaacggtccaggcggtggacggggataacacttgtataagccatctgtcattaccactcttcctttaccagatgccatgtctctttggtaagccggagcatttcctgtacactctgctcacttgccattcccgaagcattcgcaacatgggcaagctggttcgcattattgcacagacccgctatcttcctaagcagttccgggtgatgttcacaaggttttgcgtgtacctgtgctcctaagatcagcgaacgcataaactcttcccgactcagtccgcttttttccacctgttcctccaattccctgagttcccttgcatttaaccgcaccgggatcacatggtttcgttttcgcattgcatcaccgtcccttctcttttctctttcatcatatcgccaagctcctcatcggattttttcgctgcaaccatgcaacaggtcactatcactcctataaatcctccgctcatcaatgcgattacaatcattactccatttcttaacatgacttgatccttcctttccatttccgtctgtgtccgggggattggggttctccccaaagtgcgtttggatatccaaacgctatgcttgcaaaacgagtaccgccagtttctgtagcaccggattgactcgattctgatttattttgattcttttatctgtaccagtccatcaagtgtcgtacaaatgatatggagtctgtctgccatactgatttcggtattcattgttcctgtcacttctttcccacatacgactaccatccggcatctccgtaaaaggatatgggacattcttccatatccctgcatatcttctgcatcagactcttccaagaatggtgagaatacaaatctcggacagattggtacatacccaagttcatagatttttctgcaatatttctgcacttttacccggctttcttctgctgaacagcacacataagccagcgcctgttccatacgctccatctccttcctgcatccagttggatgccactcattttctctataaaaaacaagatgtccaattggacatcccggctacttttcatcctctttctgctctgcttctaatgcaattttcactctgtcacttcccagtttgtagtaggcatctgttacctcaattcccactgcacgataacctgtcataaccgctgcaaggacagttgttcctgctccgacaaacgggtccaggatcagccctcttggttcacaaatctggataacatctttcataagctgcaacggtttctctgtcacatgaatccggttctgcggattgccatatcggaagacgcccggcagacaagataccggacggttgatcggcatcggtccgttactgccccacacaatatattcagcctgctggcggaaacggcctttctgtggacgggagtttcccttatcccacaccgctgttcctcgccagatccatcctgcccactgcaatgcatcggtaatcgatggatactgacgccagtcaatgaacagacagatcggagcacctttcttgcaggctttccgcacatcatagagccattcagccatccagtgcgtccaagatctctggtctttgttatccccatcgaaatccggaagtgcattggcagcactcatactgctgtatttctgatttgtagtacgatttctttcattctgttttgttccaccggatgcatacggcggatcggtaataactgcatcaaagattcccggctggaatgctttgaccagttttaatgtatctccatgtaatattttccagttttccccttcagtatattcctccgggtatgttccctctttcataagttcttccaaactcaggccatttgtcataggcatcatcctttcttttctcagcgttccggctgatttttcttctttgtctttttattttctttgggcggcggactcaactcagtttctacatattcgctgataatcaaaagtgctttgtaattttccccttcagtatattcctccgggtatgttccctctttcataagttcttccaaactcaggccatttgtcataggcatcatcctttcttttctcagcgttccggctgatttttcttctttgtctttttattttctttgggcggcggactcaactcagtttctacatattcgctgataatcaaaagtgctttgtaatagtccccactttccaatacccttttacgcatttcttttgcttctgctgtctgtttattctttttcaaaagagttgaggcatcgcccataatggaaaaaatattcccatcatgtccaaggagctgtaacttgggacgttgtttctcaggctttgtcggaatctgctctgttttcttttcatacattttcggctgttccatattaggatgccaaaaatgcacattcatcgttccaccatctaccttgatatccctctgttcaaatccttcaccccacccgtcactgtactgccctgtaatgtattcggtgaattcctgtagttcttcctgacttaagaattcatttaattccagtttggtacagccgtacaggattccgtctttgttttctatcgtaacaactgcactttgtatcttttcctgaatggactcacttccgtcaaaatactgcatgagatcatcttccccatagcgttccagttcttctcggatgacttcttcataatcggcaagttctgttccatctaatggcattccatattcatcactctccgaccactcttcttcccattcggattcttctgaataaagatttccagtcagctccgtcaacagatgtacgtgcatcgttcctttttcttccattctctatcaccttctttctaatggtctgtccctgcatttatttgtctgctttttttctttcgcaaggtctgcataatctgccccttctttttccggcagattgcaaataatctgatacgttccctcgtaatgttttttcatctgttctttcgcccatctcccggcaaagtcattatcggtgcagatttcaatttctttgatttccggatggttcttcagaaactcttccagtgcatccggcagctttttaaaacgttcactctgtatctgtgtgttttctttcggagcagcgattcctccaagggaaagacgatatttatccctctttccttcttccagtgtcatgtgggccagtgcatcaatacacgcttcatatacgacaactcgttttgtttctctttcaggtggaatacaaaagctgtactttttttcactcccggtctgctccatcttgaatcctttcccgtttttttcatagattcctcgcaggaatgcatatcttgcttttccggattcatcttttccaacaaaaacagcgttatggtacgggacactttcataaaggatttcatgcgaaatgcaatacgtgatcacttcatcgctgattcctctgtggtttaaataagccctgattcgtctgcaattacaatatctctccggcagcttaaagggtggtttttcctttttcgcagactgtgtcggaataaaagacggactctcttcgcacaacagttttacggcatctgtaaatttcattccatctacttcaatcaggaaccgcagtgcggacacgccaccgatatctctggatttccaatgccatttgctggacagttcattgattttaaaactgtcatggtccgtcaactgccattcatttctggttcttgtcttttgcaaccgctgtgcctgatgcgtccgcaaatactcatacgcagtcatattttttgctgcctgaatctcttcttccgttacccagggcattacagaattgcatcctgaagatccagtaccttatccgtccgctcccaaggaaactcctttcttccaaaatgaccaaaaactgccgtctgccggaaaatcggacggttcagtcgaagggattccatgatctgaacaggtgtcactccaaacaccagtgggattgctgccgccagacaatcatccgcacacactttccctgtatcaaaggtatccacctcaatcataaccggctctgctactccgattgcataagccagagacacctgacacttgcttgcaaactcagcagctactatattttttgcgatataccttgccatataagctgccgaacggtctactttcgaacagtcctttcctgaaaatgcaccgccgccatgcggaaccatacttccataagtatccaccatcagctttcttccggtcagtccggtatctgcatcaaaccctccacacacaaattttcctgacggattgatcagaatcttcgtatcctcatccggcggcagtaatctgagtgctgagcgaagcactttctctctgatttcggcatctaacttcttcaggctcttttctgcaccatgctggcaggaaacaacaacactttccagtctcactggctttccatcttcatattctacggttacctgtgcttttccatccgaaaagatatctttgatatatccgcttcttctgcaagccgaaagttcacgtgtgatccggtgtgccagaacagtcggcattggcataagctgcggagtatcatcacacgcatatccgaccataacaccctgatctccagctcccctgcttctatctcttaattttgcgccgatattatcccgaaattctttcgacacactcactgctttcgcaatatctggactctgctggtgtacaaacgtatccatttctatcccatctgtacaatatccacactcttctaaaacttttcggatcacatcaaacactggtggttcatatccgctggtgatttctcctgctacaaacacatttcctcttgtagcaaggacttcacacgccactctcgaagatggatcgtaacgcagacattcatctaagattgcatctgctatctgatcgcatactttgtctgggtgtccttctgttactgattctgctgtataaaaacgtctcatcattcttctccttatatacagacagggcagaagctgctttatgcacatctcctgccctgtcagattggtttatcctgtaattcttattttatttttcttctgtttcttttttgttgtctgtcatttttgacttctttctgcggtatacagtcactcctgtagctgttccggcagatgccagtgcaagcagaacaaacggccatactttctggttatcacctgtttttggtgcatttgttttttctgttgttttctccggtgttctggcatctttcatttctactttctggacttccattgtatctttcaatgtgaatgtaacatcttccgcaatctcgtaaccatccggcgctgtgatctcacgcagagtaagttcttcattgaccgggagctttgcaacggaatgtggctttccatccgtaatccactcttccaaaacagttccgtctttgcggataatctgaagctttgccccttccagttcttttccggttgttaggtctgtttttgaaatttccactttggaatattcgtctttcatttcaacctttgtcacactgccatcttctttgacttcaaacgtcacatcgctggcagacacataaccatcttcataaggagccagttcttcatgtaaggtataacttccttccggcagtccgtaaatgacatgttcttccttcgtactgatccactcttccaaaacagttccgtctttatcaatgacctgcagttttgctccttccagctcatttccggtagtcgcatctgtcttggtaatacgtgtctcggtcggctggttctcaacttctttgttcagttcaatcttttcaagattctgattttcgtaggatgcatctaccttccatacttcctcgttcgaaagatatccagcttttctgacttcctctttgacataatattttccatgtggaaggtcactgtcaaaagtcagatttccgttcttattggttgctttcttttccagcagggtatccttctctacaagaacttctccctgattagaaacgatatcttcccccgcatacagtccgaagatgactccttccagcttttctcctgtaacagaatccttcttttctactgatacggacaccttctgtctctcgtttttgtaggtaaccccttcataaacaactgcctgcgtatcatcctcggctgtcagggtaaattctttctgctcggtattcaggacaaaattctctcctgcaacaacttctttcagataataagttcccatcggcagattgtagataactgctgttccattttcatctgtagtcagtttggctaccaggtcatctttctcataacggacaactggatttccttcttcgtcctttgctccgtccggtgaatagatggtatctttggcatatacttcgaattcagcaccttctactccggtttcttcatatttaaagcctttataaatacctgtttcttctttaccagatacggcatttcttactttagagaccagtgcttttacttttgccagaacagaatctcctgttacttcggtaagctgttctccctttttcgtcaggagcaggcttcctacctgttcatcgtttttctgttctacctctacaatcgctgctcctgtatctggatcaatctgatgtgcagtgtttgaggatactgtaattacaataccgctctgtggattttctttatatgttccttttgtagtctgttctaatggtgaaataatcgttgttccatcatacagggactcctcgcttccctgtcttacaaatccttccggtgctttcacttctttgattcggtaggtagagcacttcagttcctgcggtgtgatcagatatccttcctcgtttgtttcgaatacactgatcttttctttcttcggatactgaacaacctgttccacatatttcttatttgtcacatcgtaaatcttataagaagcaccagcctttaaaacagtatttccagtctgtgcatccttctttacaattttcaacaagaattcaaacggacggtcatcaaatactctccactgcattggttctctgctgtcattttccacatttacaacaaatggatcaatggttttcagattctccggggtagtgctttccactacaacataacttccatacggcagttccgggctgactgcatatcctttggtatcagtgatcagttccggtactggtacggcggttccgttctcataagtaactgcaacctgctctttgctgaagtcataatttttgaaatcgcttgctgtatagctttctccattggctggcttcagttttccattttttacctgtgtcaggtcgctgatcagatataccttaaatcctgctcctgcaaccaggtctgtttctgtctgctctccatcttcactgattttgattaactggaatgcctgtttctttacctgctcttttaccgtaaggtctcttgtcacttcggcaacatcctgaccttcataagttactgatacctcgtatttggtagtatccagtgtatatccttccggtggagtgatctcttttacatacatttctccaaggtataattctgaaaattccagtgttccgtcatctccgatgactccctgtgcaatcaggctgtcctgtttatacagaacccctgttgtgccatccggatgcacgatgtcctcttttgcatacagaccatacacagcaccacgaagaacactgtccccctgcgctttaaatgcaagtgtttctttatcgatctttgcgattttcacctttccggtgactctctcatcggttgctgttacagtcaatgtctttccggcagtaacagccactttatatacttctgtattcagtttgtatcctgtcggagcagtgatctctttcacgtacactgttttcagtgcagaatcaaaataatcgctgactgcttttccgtctgttccggttgctgacattgtcatcagcagattttcacacttcttatcagtataaataccataaactgctcctgacagtggattctgtgtattgacatctttcttcataagttcaatgcgtgtcatattcagccactgtacactgaagcttaccggcgctgctgtttcgctttcaaatacaccgatatcctgcttggaatctccggttgtcaacaccagtgttctccatgtctttccgacagaaccatataagttgccggaagcataactgcctgtcagtaataaatctgcggacagatagaatgtatctccaccataaatctggatttttccatttgtaacacttgttcctttggaaagattatgtgctgtcacattttctggtacactcagtgtcacatagtttctgtgatctccagacagtgtgatatttggtgttttctggatgtttccatcccgtactgcattcagctttgtgcttgaaaggctcagttcaccttttggcggttcttcctgtccaaacagataattgatatatgcgataacccctgcatttacaaggtcattataattacaccctgtaaatccggcttctcctgcataagcatagctggctgcaatgtgtgtatacacatacttttcatcttccgtttttccagacagataacttcctgtcagatctcctgccccgccataaccataataaaggactttctgcagatttttattgctgtccagtacctgtgctacataacttccactcggtggggatgctttctgggactgaaggcagtatgcaatttttccattgactgtaaacaggcaagtaagataatttccaatataacttggataataaatagttctcccctttgtcaatgtaactgtggaaccgctgcttgtagctctttcagccgcagacaataccatcacatttccctcttcgatgtcctctttcagttctttgattgcctgtgcagatgcatcttcttcggatgtttcaatttctacatctgtgtagttctgcacaggcgaatccgaatcatcttcagattctgtatctgacttctgtttctctccaccattttcttcggaatgtgcctgtccttcggtatccgtcagagtcactttacgggtgatggtatagctgtcactcttatcttttggaacgaccatataagtggcaatatatgttcctgctttgtctgaatgatactctccaccattctcatctttgatacttacaagcgtaacatcttctttttctgcatcataatggattccttccatactggtttccactgcaaatgtatcatctgaaactgcttttgtgatatcatctgctgtaactgatgtatctttctggcttgttaccgcctgttcagatgcctgtacttccgtctgctgttccgagcctgtctgttcggccgcaaacgcattcgcactgctcaaggtactgatgcccatcaggacagccagtccaaaagcagcaattctggtctttaattttctaaccttcatgtgcttttccttcctattataaatagattttttcagtaaaataccgcagaagatgtttcctctgcggtacgttttatcttgcatatcgatttttttctttttttacttcctgtctggtacgttttaccgcttccatgacagactccgttggaatctggttatccttacatccttccagaattccatccagataaaatttcgatggctttgccggaacatctttgtgcggagcgttcatcatatatacaaacacttctttctccacaccatcctgattttttacccgaatcgattctttcccataaaaacttgggaatccttcataaaaatccagactcttctcacacgcttctgtgattttccataagactccttcgacatagcttcctttttccggcagaaccgttgctaccccattgcccggagcccttccccgaaatgccagccgataattttcaagccggacgttttccacaacttccgcagccggacacctgtacttcatctgctccagattcatgttgctgccataagcgaagtaatatctatctttcattttttctcacctctatctgactccttctgtcctttgatttttcttcagacactcatacgtgcttttatcatatctccacgcaagatcaccatccagatttgccagcagatgttttcgaacatttttatattcgtttccaattaacccaagtctcaataaaaatgtacgaaatgtaaatgccgggttttctgatatcagtgtctttttcatctgtgtcgatctctgattgattgcctgtgcggaaatggctaatgccagtgtaatatttgctctcacctttcctgcatgtagtgtgctttcaaaacaacgccattccaaagttcccttggaaaacacagcatgaagattcagagcataataacgggtatgatcataatgggtatgacttccatccctgcctccataccagacatttcttactcggtccattgtgattgatttatttggtatttttcggattttctccaatacctccggtcgcaccctctgacaataactatttgctcttctctcctgcactttcagtgctttgaacaggatatcttcctttgcatacataattgtcagtgcatttttcagactctgcggtgtatgattcgatgcatctacatgaacatgctgaccacaggactcatttacaaaacctccatgctgtcgcagacatcgtactacttcctgtaactttcccatttcatcataggataatttcggtgataccatttctgttgaatattctccacctgcgtctacaattcgaccgtatactttccgttgtgtataaatgctcccatcagacataaatttccacttttttccttccagatctatcactgaccagactccataagtagtgccgtcataatatgcttctgttccaaacatttcagcaacaacttctgcagcacgttgtctggtaatccctgtcatttcgatttctgtgccaaagtattggtcttttattccgatcatgcctaatggattcctttctcagacactttctgtgtgttaagttcggagtctgccttttgtaacaatctgccaattgcctcgataacattgacagttactccgtttccagcctgtttataaagctgtgcgtcagaagtgctgtctatgatcttatcaatctgccagtcgtaataaccctgcagtcgcagacattccctcggaactaaccttcttattctgccgtgatacaagatgccatgacgatcggttgcagtaattgtaaacatcggttcttcgggttctttcatacgtctgccgttctgacgaacattctcttttgctggtgttaagactgctcttgctccatcctctgctaatacaccagaacattctcctttgtatttgtggacaccgcattgtctggtattcaggcttctgcattcttccgttaccaccggcggaggtgaaagatcgacaaagtgcagcgttccctgttgaacacctgttgtcagggtatgtgcgatctggtgtccgactcttcctctcctgctgttgagattcgcataacccagatcgatgctgtccccttctcttgcaagtttgtagccgagctttgtattctctttgattggaacacctacatcatataatcctgtcttgccgcccattccacctgcctgtgatgtcagggtacagcttagtcctttgggactgtagactcttttcccctgacttcctgcccggacttgaacaagagctgctccatttgtttctggttcaggtaatacttttccggcacatcggaaatcaaaatatccgacaatatacacccgttttcttgcttgggggactccgaaatccttgctgttaagcactttccattcgacatggtaccccagttcagaaagcgtactgaggatggtgcaaaacgtccggcctttgtcatgcgataacaaaccgggaacattttcaaggataaaatacgagggtcttttagcttcaagaatccgggcaatttcaaaaaagagagttcctcttgcatctgcaaatccttctcgctttccggcgatagagaatgcctggcaaggaaatcctgcacagagtaaatcaaaatctggcattcgttctggttcgattgttcttgcgtcattacaataccactccccttccgtatcaaacagcaatcggtagttcttatccgcataagtatccacctcgcaatgtccgacacagacaaagtttcctgcccgtcttaagccttcacgaaatcccccgattccgctaaagagatcaaaaaattgaatggttgcggctatcaacctcctttttgctgataaaaacaggcggcatgatctctcataccgcccttcgttattctgtatcaattggttaccattctgttggttcttctgctttggattcttccggatcagtctctccttctggttcagtttcctcttccggttcactttccccttctggtttgttttcctctttcggttcactttctccatccggttcggcttcctcttctggttcactttccctttccggctcagttctttcttccggttgagtttcttctgttcccaattctccagttgtctgttcggattcttcaggctgctctttgctttgccattcgacctctaccttttccagtgcttcttctataatctgaattaagaagtctttctgtttcatgtgtttctttccgatgactacttttaatctctggaataattcctctgatacctgtactgctactgttcttactgctcccatgcttatttctccttttccttccactctgttgaaatgttcttcaatgacctgttgtaaaaatttttgtgtgctgctttctgtgagttcaatctcttctcttactttctcatgtaagtccatcgggatctttccgcagatatttttcatctctgccataacctttctcctttcacttttgctacacacaacatactccaaagccgcatggaaagctattcacaatacccaccaaagatatcgatgcatttcttgccttacccctagcagatccaacaatgtatgtatcgtgcaatcataggcctcaccccctttacaaattttccatttgagatagaaaatccatcatctgatctggtatttcttccgatgatggtttcgttttcaattgttccgtagtgccacatattcctaattcccgaacactttcttttatcgtcttttgaatgacttcttccatccatttccgatcctctttttccagaattgcctgaaccagatactggcttttctgcccttctggaacactttgaaatttctcccatgccctctggtgttctggatttttcaggttcgggcggaacgaatataccgggcgtgtcatctcgtccacatctgctctacaatccgttcataccctgttgcgttggcatggacgtcctctataaaaacggggcggcaaatcgcgtcctgtgcggtcacgtggcgttttaaaattgcggagcctccccccataaatacggtgggtactgcccggagatcaaacccggattctgtcaccgcagacagtattctttctatatatttccgtccgttttcctgtatgatccgtctggcctcctctgccatactgcaagattccctccgaagcacacgctcaatttgagtttctgtcacagacagtccggtatttctacgcacttgttctgctgtctcatcaatacatcggattactccaagttccagacttctgcacgttgctgcattcggaacagcattgtccagcctcataaggtcaacggtccagccaccaatatcaacaagcagaacagacggttcattcttcagatactctggatgcagagcaagcgcagagtatccctgtgggaacagtttcacatcttttattgttatctcatataactcactttcatataaaaatcgcactggctgctctttccgcaacagatactccctgaatccctgtttctctcttccaaaacttgaaagcggaagtccaacagccagaattacctctgtctttcgttccgctttccgatgcttgatttcttctgcaatggctgccaacgtcagcagataataattatcattggacgttttattttttaccagcgtctgtcttcccgtaccgcagacataatactttccttgatattgcagaacattctgcatggtatacggctcgtaatcatacccaataattccacttgggaaagacacttgtcttgttttaatggcataatagccatgatcaattcctatgattatcgcaatcacatcctttcattttttctgtttaacgtaaggtcaaaaatgttgtcactgctgcaacggatcgttgcaaaagtgccattcgtgaacacttttctatgttccagcgtcccaaaacctgcggaaaatctggtttttttataccactatcgccagaggaacactactgttccttcccagccggttataaaagatccctctcccggcggcggtccagcctgtccgggggagggatatatcgcaagtttcctttttgaacaattgcctgtctttttatttttatgagatgtttttcctgcttttgtaaaatgggaagatactccggttctgtcaaaaacttccgtatataattgcccttttttcccagcttgttatcatttttcagcagttctatttctaccatgtaatgggtatctggatgaaatctcttctcacacaaaatgctgtccccttttatataatcagatttagccgattctcttgctgccgccaagagttcataaatacttacttccacctcttatcacctcccaaaagaccagaaaaaagcagacctcttaatcgaagtctgctcctgtcggatatggtaatcctctttcttcatattttttatcgatataatttcgaatccattccctgtattcttccgttaatgccagttcctgaaattctaacaaccacttttccccttttgcttcgtcatcaagccatcgatcttctatgcactccggctcatctaacattttcatcatcgcttcaaatggctcttttacatcatcaccaaattctttccataaggcgattccatagttctccagttcaaaaaattctgtcagatatgtcaatcgttccatatcccccaatgtcattcttttttcacctgacaataatgctcgatctcttttgccacatagatttaaaaattttctcttttccatctccacatccattatacttttacctcttcctgttaaaaataattccttattacgaaacattataaaatttaaattctttagaatcaatatatatatttctgtattacgaatctttttattttataaggggagttcatcattatgcaaaagattagaccagatatggatattggtaaaaatatccaagcaattcgatataaaaacaatatgactcaagaccaagtagttgcaaaattaaatcttatgggtatctccatcaccaaaagtacctatgccaaactggaaacaaatcgcatgaacattaaggcatctgaattaattgcacttgcaaaactctttcataccgatatcaatgctttcttttccggcttgctatagttcgacattccccgactccctgtgtatataatagcatattaaaaataagaaccagtctatattcttatcggatataaaccagttcttttttcttatcaaataatataaaagtgacagggaattcagattcttatcttctgtcactcatgtaattattattctattttaaatttaatgaatttacccattcttgaatttctttttcaatgttattttctatataaacgtcatacacatttttccacattatctgtgtatactgttattttcaaccccataattataacttggtacacgctatacactactataaactgtactccattttagggaatcccagaaggatctcgtcataagaactcatatccatctcttttttcataatcgccggtctatattttttatcactcatttccacactgcttctggattttttattcatccagtcaagatcaagctttgtatatggaactttcggctcaatctcaaacaaatccgcttttgcttcctctgcgatcatctgtgctactttttttgttgttccgcttgcactgaaaaatgccactaattttttactcataataaaaagcccctttctatacgtatttttcacaaaaaaatagatgtataagatttacgttcatcttacacatctattttaagctctatcgcttcattatgtctaatgcttatattgaattttgttttatgcctgaaaagcattaatctcctcgatcattttacggactgccaaagaatatgggatattccgtctccaggcaatcaccgtactggtcgtgatttctggagaaattcttcgctgtacaagaatatcctctcgccaatactttgttgcagcaccctcaattgaaattggataccccagtccatttgccgccataattccggcattcgttccgagattactcgtaaaagcaatctgtaattttgaaaagtctttcccaaaccagttggcaagttcactttgaacgttcattctttccggcaggatcaagggctttccaataagatcttctttttttataaactctttttctgccagcggatcatccggccgcattccgacacaccagtgatcgcaatctgtgatccggatataatccagcccttcggtgtccaccggctccatgaataatgcaatatctacaagtcctttgttcatcatctcatacactgcatctgctgttgcagtatgcaatacaatctgaaccagcggatatttttctttatatgttttacatatcttcgccaatgtctccactgctgcaaattcaccgcatccaatggttatcgtgccctctacaacctcttcttttcctttcagttcctcaagcgtcctttcctcaagattaagaatctccaaagcacgcctttttaataaaattccttcatcagtgagcgatattttcttcccgtttcgaataaataatgttattcccaggtcctcttcaaatgccgccatttgtctggatagcgttggctgagtaatatgcaattgttctgctgcttttgtaaagctctgttcttttgctactgttaaaaaatagcgtaataatcttaattccatatctttatattcctacaaatttttcttgtaaccattctatcatattgcgtcccagacatcatctatatctttacctttaataataaatcgcacgcaaatcaattatatcaagaagtaaattatactgcttctttgctgtatcgttcatttcatgattcatcggtgcgttctgtgaatacaccgttgcttccgaaagctttgatggtgctgaatgatataacatcaagtcttctacaggaattttcattctatttctgatatatcaaattcaaccgctttcattaaaatcttactctgtgtcatcttttatttctattatatttaacattctaccaccaccttgatcacgccgttcctcttattttcaaaaagttcataggcttcttcgattctgctaagtggataggtgtgtgtgatcagtggttccgtattgatcttaccttccgcgatcagtctcagcgtttcttcacaatcacaaccgtctactcctcctgttttaaaagtcagattctttccatacatatccggcagaggtaacgtctgggctttatcgtaaagtgccaccaccgtcacgattgcatttggccttgcgcattcccatgcaagacggaaagtagattctgctcctgcaacttcaagaacaacatccgctcctccatgctcgctgtttgcctgaacaaaatcaaaacattcttccggcgaaactgtaagaacttccggataatgttccctgataaagtgcatacgcttttcgtctttttcacacatgatgatccgcttcggatttttcagcataacagacagtaaggtacagatacctgtaggaccggctccaatgatcagcaccgtgtcatcctcagtgatctcggaaatacgtgctgcccagtaaccggtggcaagtacatctcctacaaataacgcctgtctgtccgtaactttatccggaatcttattcagcccctgatctgcaaatggtacacggacatattctgcctgaccgccatcgatacggcatccaagagcccagccgccattttcatcggtacagttattcacataacctttcttgcagaaaaaacattctccacaaaaagtttctacatttaccgtcaccctgtctcctggcttcacattcttcacagcagttccaacttcttccacaattccaaccatctcatgaccgactgtaatccccggcactgcccgtggaacgcttccatgcttaatgtgcaggtcactggaacaaatgctggcaagtgtcacctttacaatggcatctctttcatgcatcagcacaggctttggcttttccattaattcaaattttccttttgaaacataagtataagtctgcattcttttccccatcactttctataataatttatccagaatttccgctgctgatctattaccgaatacgccattgccaaataacaaacaagataagaaagtgcaccggataaaacgcataacagaaatacttgaaccacttgctatggtacccctgctctccatgatataaccagattggaatcagtgccagcagtgcaaagctctgctgtgcaatctcaaaatgatgtcccagaatcgttaccggataatacagattccccagcataactacattcaaataatacagcccgacaagctgtgccgcaaaagaaatccaggttttcttgcgaaaaaaataaaaaagcaataccgtcagtattcctgcagcattgtaatctaccatggttatggttccaagcagaaaatccatcaaaagcacgaggcaaaccacaaaaaacgatatccatttcttttgtttcttctttgccttttcaatgatctgtatcgataatacccctaataaaaaggtccatagtacattttgatgaaacgggtaaaataccgaacttcccataatcaggttaaatggtatttctgaaattatggcaaatagaaaaagacgcagcatgtattttttcacattcgaagtataatagcatccttctgcgatcataaatgcgaaaatcggaaaagcaagtcttcctacgcatgtcatccattcctgtgctggaaatagtgtcgcccacaaatgatcacataacataaacagcattgccagaatatgtagtgtaaacgaatcaattcctctttttttctccataggttcttctccatctatccaggcatagatatctgccttttattcttttcttttcattatattatggagcattatccaacgtcaatcaactcttgcgtcctaatctatcactaattcagccagaactcaaatactcaacgcattctactcataaggggtgttcatttcttataatttatattatgcttagattaaacagaagggagtgaattatatggatttaatcaaaatcggaaaatatattgcagaaaaaagaaaagctcttggactgacgcagaagcaattggcagaaaaactgaatatgagtgacaaatcggtttctaaatgggaacgaggagtttccccaacaaaaggatattagaaacaatccatgaaacacctgcttgcgttaaaggaattacaatagaatactatattttttaacatgcatttctatattgatttgcatgtttttaatttcaaaagaaaatttaaaataaacactatataacacttgacaacagtttgtaactgttatatactgttatcaagaaaagaaggaaggatataaagaatgaaaattataatcaatacttccctaatggttcccatatatgaacagattgttgaccagattaaaatgctcatacgcaacggggaactaaaggaaaacgacaatcttccatctgtccgcacactttctaaggaactaaaaataagtgctttaactgtaaaaaaagcttacgacaatttggaaagtgagggttttacggttacagtacatggaaaaggcacttatgtagcggctacaaatacagaactgcttttggaagaacagaaaaaagaattggaagcggatttggagcaggctatccaaaaaggcagacgatgtggtattagtgatgaagatataaaaagtttatttgagttgatattggagggttgatgtatgttaaaaattgaacacttgaaaaagcattatgataatttttctcttgattgttcattagagcttatgtctggatgtgtaacaggcttgattggacaaaatggtgctggaaaaagcacaacatttaaggcgatattaggtttggtttcaactgacggcggaaatattaccatacttgggaaggacagaaaagacttcacagcaaaagataaagaggaattgggtgtagtattgtcggattctggttttagtgggtatctgaagataaaagatattatccctatattgcagaatatgtactcaaaattcgacaaatcactatttatagaacaggtacagaaatttcaactacctatgaataaacagataaaagaattttcaacaggaatgaaagcaaaattaaaagtgctggttgcaatttcacacaatgcaaaactgctgatactggacgaaccgacagcaggtttagatgtaatcgcaagagacgaattgcttgaaatgttaagagaatttctggaaaaagatgaagaacgctccattttaatcagctctcatatatccagtgatttggagtcgctatgtgatgacctttatatgatacatgacggaaaaattattctgcatgaagatacggacgttcttcttagtgactatgctttattaaaagtagacgcagaacaatacagcaagctggataaacagtttatattgcgttccaaaaaagaaacatatggatatagctgtctgacaaatcagaaacagtattatatggagaattatcctaaaattgccattgaaaaaggtacaatagatgaagtcattaccatgatgataagggggacagaacaatgaaaggcttattcgtaaaagatttgaaattgatgatgttacagaaaaattttctgttgctcattttggcgattgtaatcggaatgatgatatttactgatgatgtgatattcccattaggttttctgagtttcattgtatcactttttacagtaagcacaatcagttatgatgattttgataatggaaatgcgtttctgtttacattacctattacacgtaatcattatgtgagtgaaaaatactttcttggtctattattggggtgtatggcttgggttttggcaactgttttaggaataattacaactgtattgaaagatacattacctattacagacttagtacagagttcattgatgattttacctattatgattgtcgttcaagcaatcatgcttccttttcagctaaaattcggtggagataaaggaagaattgctatgattggtgcatttggcggtctggcagtaatcactctcgttatcgtgaaaggagcagaagccattttcaatattgatttagttagtctgttagataatatgccaactgtaagcatgggagttcttatcgctattgcaattattatcgctttgttgatgttattggtttcaatgaaaatcagtttgtcaattatgaacaaaaaagaattttaaaaaggagcaatcatatggactttacaatattggctgttgtactactgctgtgcggtggtattcctttaaggaataagatatataaggaacgcaaaaagaaaaaagaggataaaaagaaaggtatataaagtgggtgatttcatggatagtattttatgtgttcttgccttgattgtatttgcatattggttttttatcaaacgtaacaaaaaataattgctgttgtgaggagaatataaatgaaaaatactaaatcatgtcctaaatgtggctcaaccgatattgttcgtattccagataaccctaaccgccatgccagcggaaataatatttacacaagcacttatacgctatttgggaaaatccctgcaatacgttatgtttgttgttcatgtggatatgcagaaaattgggttgaaaacgaagaagaattagaagaaattagaaaaacatttagatagttgaaaggcggtattgatgattatgaaagaatataagtatgtagaagtgaaatttgaggcaaaaggtgtgctattccattctgcttctgaaccaaaagaaataatcaacaaatatgctaaagagggatattcctatgttggttttattcctactttaatagatgcacatggcggttttagaagaattgatttgatatttgaaaaataatctttaaaagcgcaggtgatactatgggaagatattagtagcagaattttgggataatgaagaacattatttccagcaaacagttgaatggctatcgaaaaagatatgtaccactcctgcttatatacaacaagacaggacagattttataatcaatccttttactcgtactgtatcacacaaaacaggcaatatcatacagcttacagcaaaagagtttgatatactttattttctcatttctcataaggagcagttttttaccaaagaacagatttatgaaaatgtatggggatatgactatccggcagaccctaataatctgacttcattcatacgaaaattaagaaagaagattgagccggagccggacagaccacgctatatcgtcattgtcagaggtgttggatataagtacacggaaaatgaggaaatggtaggcaagacagcaacaccgccggagtgatccagacgtggtggcggtcgtaagacatcaagccatgccagttttgctggcaaacggctggttcactctgacggtggggcgagcgtcagcgagccataaagcccccgttatctaacaaggggggcacaaaaaacaagagtcaatatacattaacaagcggaaaacgctgtatttacaaggcgaaactgcattttacatggtgtgatataaattatgccattatcacttgggaaaattgaacaagacataggaaagacagttgatttcaaacgagaaattgattgtctttttcttttgcagaaatttaagtataggcaattatcaaatacggtagttgcttttttgattggaggaattttagaatgaatgataaaaactttattgaagaactaagacaaaagcgtgaggaatacggagtaacacaaacaaggcttgctgttgcctgtggtatcagccgtgaatattacaaccgcattgaaaaagggaaacagccattgaatgacgaattaagagaagtcatagaaaaacagattgagcgtttcaatccgcaagaaccactattcttattgattgattactttcgtgtccgcttttctactacggacgcattggcgattatccgtgatgtattacaactgaaatctgattatatgctttatgaagattatggaaaatacggatatgaaagcaaatatgtacttggcgacatcaatatcatgtgttccatgcaggagcatttaggtgttttattggaactgaaaggcaaaggctgtcggcaaatggaatgttatctgctggcacaggaacgctcatggtatgacttcatgctggattgtatgacggctggtggtgtgatgaaacggcttgatttggctatcaatgaccgagcaggaatattggatattccaaagttaaaggaaaaatacaaggctggcgaatgtgtttcctattttcgtatgcagaaagattacagcggtacagaaagatgcggtagcgatttaccaaagaatacaggagaaaccttatatctcggttcaacaagtagcgaattatatatgtgtgcttatcagaaaaattatgagcagtatgtcaagaatggcacagaaattgaagatacggagattaagaaccgttttgaaatacgcatgaagaatgaacgagcctattatgcggttgtagatttactgacctatcgggacgctgaacgcaccgctttttctatcatcaatcattatgtccgctttgttgacagagaggacgacaagccaaaaagtcaatggataacaaatgatgattgggcatggtttgtaggggaaaacagagagccgatacgcttaaccacaaagccagagccttacactttacaaaaagcgttgcattggctacaaagacaagttgcaccaacaataaaaatggtacaggcattagacagagaaaatcatacaacgatactgaaagatatgattgagcaggcagaacttaaagacaagcataaacatttattacaattagagaaatcaaccatagaagaacgtatagataccgctgttccacaagagaatgacggtattttttaatgtaattgaaaaatttcagatttagtcagcaaagagctgttttcattccctatgtgaagtgaaagaagaaaaataaattttttattaaatctgcaacaaaacggctacttgcgtacagatatggtgcgagaaaaggaaatctaaactttttttgaaaataggtcattaaatcggggcttgctgtccctatatgaagtgaaagaagaaaaaagttttgaaaaaatgacggaaattcgtgatttgtggacagtgttctatgaaaagaggaaaagcatcatcattttgtattcaaacaggcattagcagttgagtgttgatgtgaaaagaggaaaatactttattctaaacttaacaatttaaggtttccgttccctatatggtgcaaagaaaatatttcattctattgttggcagtaacggtatggtttgggtagttagggtgtgaaaagaaaaataatcttttttcgtcattaacttagcaaaatgacaatgtctatccctatatggtgcaagaaaagaagttaaaatttttccatttcaacttagcaaatggacgtttgctgtacagatagtagtgaaaaaggagaaaatcaaccgttgattgcccaaatgaaccgttccatttgtactaataacggaaaaagttttggattttggttacgtttcccctcttttccaacgcggtatataggaaagatgattttcttctttcgtgttctttgacaactgaataaagcaattcaatacgtttgacagacagcgagccgttgaaacaaatacgccacgacctttcccctgcaagagcgagcgaaaacctatttgtgttcttataaaagatttgtcctcttttatcgccatgacctgtactgtcagataatgatactcccgtacagccacagcttgagcgttcagagcgtcgcacgcaatgggtacggctacataagaactatgcagaggtggaactcctgtgggctatgacaaaagccgttgaattgtttagaaaagatttttacagaaaggggggtatgtgttattgctgatattgtaaaaacaaggcaagaaaagacaaataataagcgtggcattggcaacagaggaaaaacaaagattgttgtaaaagagcatttttctgaaaagggaaagacaatggaagaacttctgactgatgttatgcttgaaaaggcaaagcagacaatcgcataaattcggtgcagttgtaagaaatagattgaatgtgaaaaataacccatgttatactttacttgcaagcaggtattgtaaacatgggttagttataaaggaggataactgacaatgaaacaacagatttacaatactgcactttatcttaggttaagccgagatgatgaattacagggcgaaagttccagcattaccacacaaagaagtatgttgcgtctatatgcaaaagaacatcatttgaatgtgattgatgagtatattgatgacggctggtcgggaacaaattttgaaagaccgagttttcaaagaatgattgaagatatagaggcaggaaaaatcaactgtgttgtaacgaaagacctttcccgacttggcagaaattatattatgacaggacaatatacagaattgtattttcccagccataatgtccgttacatagcgattgatgacggggtagacagcgaaaaaggcgaaagtgagattgcaccatttaaaaatatcatcaatgaatgggtggcaagagatacaagccgtaaagtgaaatcggcatttaagacaaaatttgcagagggtgcgtattatggggcttatgctccgttaggatataagaaacaccccgacatcaaaggaaaactgctggttgatgaggaaacaaaatggattgttgaaaaaatcttctccctagcctatcaaggttacggtagtgcaaaaatcacaaaggtactgcgagaagaaaaagttccgacagcgtcttggctgaatttcacaaggtacggtacttttgcacatatctttgagggaaagcccgaaagcaagcgttatgagtggacgattgctcatgtcaaggcaattttaaaaagtgaagtctatatcggaaacagcgttcataatcgacaatcaacagtttcattcaagagcaagaaaaaagtgcgtaagcccgaaagtgaatggtttcgagtagaaaatacccacgaaccgattattgacaaagaagtgttctatcgtgtgcaggaacagataaaatcaaggcgtagacagacaaaggaaaaagcaacgccgatatttgcagggcttgtcaagtgtgcggattgtggctggtctatgcggtttgcgacaaataaggcaaataaaacgccatacagttattatgcttgcagttactacggacagtttggcaaaggtacttgttctatgcactatatccgttatgatgtgttgtatcaagccgtattggaacgattgcagtattgggctaaggcagtacagcaagacgaagaaaaggtgttgaataagatacaaaaggctgggaatgcagagcgaatacgggaaaagaagaaaaaggcaagtgccttgaagaaagccgagaaccgacaaaatgagattgaccgcttgtttacgaaaatgtatgaagatagagcctgtgagaagataacggaacgaaacttcatcatgctgtcggggaaatatcaaaaagaacagatagaactggaacagcagataaccaacctaagagaagaattaagtaaaatggaacaggatatgataggtgctgaaaagtggattgagttaattaaggagtattccgtaccaaaggaactgacagcaccgttgttaaatgcaatgatagaaaaaatccttattcacgaagcaacaacgaatgaggataacgaaagaatacaggaaatagagatatactaccgatttattggaaaagtagactgataatgaggggtcatatctttaactaagggaaactggcatatgcctgccggacgtgtcaatttatatggaattgtgtagcatacttagaatcagcattaatgaatttcttgcaggtgaagatatcggtgctgaaaatgtaattgaaaaatcagacagcaatcttattcagattacaaaagagagtaaaaagaaacaaaaaaatttaaaaacaattcttgctgtagtaactgtttttgcagtaattgtctctgcgatccttggcactttattctttcacaaactgatacagccaaaaaattatattaccgcagttgatcagacaagtactgagatgaaaacagcagaattattatccggaacagacggcgcatatctttttcattattttacaaaagatgaatttaaaacactcaccatttatgtatctgaatatcagtctgggacactgatcagtaaaagtaaagtggttgatttggactatgacggaatcgattccccttccagaggcgtcattgctgttgtgccggattttgaatcttttaaggtaaaattaattgtagcagatgattatgcaaaatattctacggattttcctattttagaaaatatagaaaacagagaatattatggcagaagtgcaagccagataaaaggggagattccgattcagattcattcagcttcgacaatagaaggcaagactgctatcccttcagactctgaacagggattaatggctctaatctatggaaaagacgggctgtcagggattcctatcacggaaatggaaaaaggaatcgttggtgtggaaaatgattatgtatattatctttccttccaatttgggggtaatcaaagtttttgaggggatgtctttttgagggtttagattgacataggaccaatttttagattgacgattccttaagggtctatatcattgacaacaaatattataaggctttctgtatttttacagtttcatagcactgcggatgcggttctcaataaattcttctccaaaatctgtattcaggctgagatcaaagtttccggctacaccccacatacgtcgggtgtaatagcgatagttatctgcacgcagtttttcatttttcttaaccgtagctttggcttctccctcagagatattctgtctctgtgccactcttctaattctgctcacaagaggtgctgaaaaaaatactttcaaacaatttccggaatttctgagaacgtaatctgcacaacggcctactatcacgcaattgccttttttcgcaagattgcgtacaacctggcattctgcctcgaaaattttattcctcggcgcttcatcctgtctgtattcagatacatctgattgaccagatcataaagaaggctgtttgtcatgatctcctcgtttttcttaacgaattccggtgtgtatccgatggtccctgctgtcatctggataatctccgcatcataaaaatcatatctttcaggaatgcaagtttcttaccgatgagtctggcgataaagcctaccagaagggcagcaataacagtaccttctcttataccagacagtctgtccgttgcgattttcccctgatataaaagcaggcaatgaaattaccgcctggtttcaaaacacgccatatttcatgaaatgctttttgcttgtccggaaatgcatgaaaaccattcatactgacaacggtatctaaaagcttaaaactatcgttctctaatcttcctgacattacgattcatgaggtgtcttccaatatgtctataaacaaatgctttaaaggctgaaatttcttgatgatgttccttcaacagttcatctggacaatcataaacaccaaaatcctgattgattccctcgctctgaatataagtattgttcctatcaaactcaataatgagatttctgaaatccttgactgctactccataaccgcaaaatgcacctgtacattccgaattttgttcctgtaacttctttatgtaggttttatccaaaatgaaagcttccagttcgtaccactgattttcaaaattaatttctacccagctatggaaaatactttttggagcattacggtaaacaaacccggtcatagcccctttctgcaatcttttatcaatcgtaaaaccatgtactctgcatggaatattgcaggcacgtaaaagtgccataaataaagttccttttgtattacattgtccataaccatctgcaagtacttttgaagctgaaattccgtcatcaatattatatccaaataaaacatcatctcttacatagttgtagattgccttaatcctttcaaattcacccatttccttccatttcatattttgaataagtttttgaattgccggattagaaaaatcaaccattcgtgtttccctaagatacttatctttcatttcctatcgcctttcccataggttttctcacaacacaatgcattcgaatacctttacgaatttcaaatttttctacttttaatcctgcttttttgcaacattttatgaccacatctcttgttgacacttggacatctccatgtccgcatatatttgccaacggcatttccaatgtattcattagccataccaatactttattgtcactggtcacatctctcagtatcaatcttccatttggacgaagacatcttttcacactgtcaaaaaatgcctgtggatccggataatgatggaagctcatagaacaaataattgcatcaaatgaatccttttcaaaaggaaagttctcacagtctcctacaacaaatgttgcatttgaaatatttttcttttttgcctgttcaatcatggcaggagtcagatccagtcctgtataatgtcggtctggatatttttctgctaataaagaaatcatcggagcaggcccacagcctgcatctaataaatctctaaatggctccttctctaattcttccagaatatccggataatccttcttacacatttcgtaaataccagcatagctactttcatatcttcctgctgcttttgtaaactctttaattgacaattttttatattcttcatttttcatgcttttttctccaatcactgtgcctttttcgccttgcatccgcatttcttcatttttttcatataagcataaaactgcttatgcaattccctcatttcatctggtgccttcatagcatgttgatacataaatttatctccaaaactacttccaaatgtaactgccagcataatcgtcagaaatgacaatggcaaaaagcgaaaaatattcattttccatggtgacagtttacccttttgttttcgcaaaaagttaaaatttcttttcagcctttccgctgttttcctcataattttccattctttttccactttctccggatcgtctgattcataatacgcatccgcaatcggtaccaccatagcaagatgacaaagctgccatagatgcatatccgttactttctggtatggtatatgagcattcctcaatatctctgaaaactgcttaattctttcggatttatttcctgatttttcttatatagcaatccattatttcttaaagcctcaaatctttttcctctggcataaatacttgtatcataaccggcttctgcaaataaagccgcatacaaggagccgatcacaccagcaccataaatcaatattctcacaagaatcattcctctcctcttaccccagtgccacatccaagatcatcatcaaactaaatccaagtgcaaagaaaagcgtaccgatattcgagtgctgtccctgagacatttccggaattagttcttcaaccacgacatataacatagctcctgctgcaaagctgagtaaatatggtaatgccgggattaccagctgtgcgacaagaatcgtcattactgctccaatcggttcaacgactcctgaaagtacacctcccagaaatgcctttctcttactttcaccctctgccctaagcggcatggatataatcgctccttctggaaaattctggatagcaattccaagtgataaagcaagtgcacttgttgctgtaatctgtgcattttcagcaagaaatccagcatacattacaccaactgccataccttcagggatgttatgcaatgtaactgccaacaccatcatcgtagtacggccaagtttgctttttggtccctctgcctgatcacttccaacatgaagatgcggaatcaaatgatcaagtgcgcgtaaaaacaatataccaatccagaacccaacaactgccggaacaaacgataaagttcccatattctcagattgtttaattgccggaatcagaagactccagattgaagcagcaaccattatacctgctgcaaaccctgcaagtgcacgttgcagtaacttgctaagtgtttttctcataaaaaacacgcatgctgcacctagcgttgttccaacaaatggaatcagtataccttcaaaaatatttattcgcattatattttccttccatatatgcttgaaaaaattcattggcaaaaataattatcttcagcggtatagtattagttctatagcttattgattatattgcctaatacctaatatatgttattctataatctttcatactttcattgtgttagttttaactaaccatctaacataaagaaaaccgtgcaaaaagcaaactataattttacacggttctcttatgcttaagtatatcacttacgtaatcatataacaatatatttctttcaacaatttacaaaactgggcggtggaatttactctttcacacaataatgttatggttgtatctccttctgacagcagtactgtaaaaatatcatatcttccaaaggtataaattctccgtttttgcattcgactctacgattgctgcatcaatcttctgaaaacgttctgtcaaatctctttcctccttcgtgtcatctgatacaatacggttaccattacagaattattttcccaagctgccagaatgccactgcactcgccgctgccacattcagcgaatcaacgccatgtgtcatcggaattttaaccgtataatcacatagcgctattgtctcgtttttcagtccttcaccttcatttccaagaataactgccaacttttcttccttcatcagttccgaatcatcgatgctgaccgaatcatcagtcagcgcaagtgctgccgtcttatagccaagctttttcaattctgcaatcgcctgttttggccagattacttcccgcttgcaccgcatttcattgctatcccggataaatgtccacggaatctgaaatacggttcccatactcaccctggaagcccgtctgtaaagcggatcactgcatcctgggctcagaagtaccgcctccatattaagagccgctgcagaccggaaaattgctcctacatttgtcggattctgcacattttcaagaatcgcgattctgtttatcccatcacacagatcctgaaattttcgaagcggtttccgtctcattgcgcaaagcattcctctggtcagtttgaagcctgtcaatttagtcagcacctcaaaatccgctgtaaaaatcgatactttcgtatcatcaaatctgttcataatctggcttgtttcttcattctcttccatctgcttcttttcaacaagaacagacaatggctcataacctgcatccaacgctctgccgatcaccttcggactttccgcaatgaacattccctcttctgggtgatctttattcagaagccatgcttctgtgcatctggcataaatatccaattccggcgcattaaagtctttgatttctattacgttcagcatttcttttcccctgttttcatccgtatatttaatccgatcaccttttacagaccttcgcgatacaccttattgatcgttgcctgcgcatgttccaattcttttttctggataattgcgttccgatcgcttagaattgccagcatctcatccaccacatcttccggtcgcggatctgatatgcggtacaaatagccgagcattcttgttgctgtataatctgtgttcatctgtttataagcaatttccctgcaaaggctgtccggatagcctttctgttgcagtgctttgtataattcatcctgttttgattgtgccataaattattctccaatataatgctttttattattcttctcttaaaaatattgattccaacaatctgcatcccgctgtcgtcttaaaaatacgggatttcgcattttcaatcgacacttttgaaaaattactctcacttgcatttacaagaaaatctgcctctattaaaatctgataatctatcccatctatattggtgtatgtatgatgatgtgtgaccagccagataatacgctccactttctgttctgatacaggcatttcttcaaaaaactcctttaccagcggttcactttcaagttcctgatttttaccatttgtgtttccatatttttcacggcaaagtggacaggatatatcatgcaccacagctgcaagttcaagaattccctgtgtgttttcatccacactttcctgctcccctatcgtctttgcatacgcccatactttcaggaaatgttcgatatctctcaaattcccctgataaaaatcaatcattttttcaatggcaactgctgttattttagatttttcgtctttcattgcattcttcctcctgacttcttctgatttatcttttataactatagcacacttttcatttgcaaatctattttttgtattctagtcttgcacctgctagagcgcgcccatgggacacacaaatggagctctaaccttttacagttaattctctatttgcttcgcttgtcctgctgctgaagataaaacattgccttttgagtttcaatctccgctttcagttcttcttttgtcggcaagtataatttgtacttggaaacaaatttttcaatgtacttagagtatatgaaatttgggctttgtcttgtagttacgaatatccgcataaatagaaaaagccctttgaaaaaagaattttctcctctctcaaaaggcaagtcaaaaaattaatatctatgtgttataatgttccactatatttcgaacgaaaaaatatcaaaatttcagatattttttaccttaccagacagaatcctcacacaatcattacgttttcctcgggagagagcattgcgactacaatcccgataaaagaacttatgctctacttgccggaagaagattttctaaatatctcaaagggcgttgttcttcgaaaaaatcaaattgttcatatatccgacgaaggactttatacaatgactgatggtgctgtctttcaaggaagaaaacgtaatctgagtcagcacaaacaaatccgtaagtcacttggtttaaatgtgcagaactattcggaggtttcagaagacagctcacttcaattatttgatagctgtagctttctcaatgacatgccacttgctttttgtattattgaacttgtatttgatgcggagggacatggtgtagactttgtattccgttactgtaatgatgaaatggctgttgttgagggcgttcccgtttcagaaatgttgaatcattccttttatgaagtctttgaaaatggggataaaaaatggcttgttacttatgcggatgtagcattaaacggcaataaacatatcctgcaggaatatagtccggaaatcgacaagactctgaccatctactgttttcaacctgccagtggatattgtgcatgtgtattgattccgtcttagtgttctgctatttggcgtatgcgattacaaaattatttttctgtaaacaaaaaagtgcggaagtccttgattttttaaggatttccgcatcttgaattatcttttatttttctgaaccaggcaatttttttattttaacaaatcgatcagcgtatattcaccttttggaatcttagctgttctatgatactcttttattgcttccacaagaatcccggaattagaaaaataattaaacacgtaatcatatgattttacgtcagacattctaagattttccttgcaaaaatcacttggttttttccctgactttttgaattctttatactgattttcagcaaccagtagtctttctggcttcctatccatttataatcttgttgtttactgatgcttcaagtataataaaatctataaaggaaatacacgcacagcatgtggacttaatgcctgataatcctcatgttcgcgatatacagggaggttattctcatggggaaacaatctacgagagaaaataagacaatttatcagatttgccgggaaaaagccggtctcaccagatcagaagccagtgaaaaaatgactgctgtttctgattctaaaattgaaaagtttgaatatgaaatgcaggaacccacaccttacgatatcatccagatggctgatgcttacaagcgcccggatctctgcaattattactgctctcataaatgcgaaatcggtcatcgttatgtcccggaggtcgaagtttctgatttatccaatataatcctggaaaccattgccagtctgaatgagattaatcctcttaccacacgtctgatccagattgcccgtgacggtaagatcagcgatgatgagatcaaggattttgcttttatcagtaacaaactggatgaaatttctctggcaatagattccctgaatctctgggttgataaaacagccggagagcagggactaaacatcgaattgctcagagaagaaaaaaagaaacagaaataagtatgaaaaacaaggcagcgaacctatttatggtccactgcctctttcctttacatatactgtaactggtttatgatgtattccgttctgcggatagcttcttccacctgatgtctggcattattgattcgatcctgcaccatccaatccacaacaaatccatcaaaaaaataatctgcaaaggataagaaatctccagtattgatgttcagattacaaaccatgttcacatcatttaattccctactgaaattacgaagatcatatttcgcctgttccatattttgtttggcctgatccatcttggagtgtttcaacatcgtagaaaagaatccaccgccaaacatatccaccagtccccaattttttgcactgttcaagttttcttttgctgtccgaagactacttaacgctcgttgtcctgcttcaatcgcttctcgtttctctttttctatatcatatcccataatttcttccctcctcgtatttttatgagttagatgatataagtgcaatgattccgccgatgatcaacaatggaaatgcaatataaatcagtccaccaacaaccattcctatcaaaatcaccggaaaaaatacaactgtacagagcaactttaagattccccaggatgcttttacaccaaatataaaaaattttccaataaaccagatcatgcatatagtaaatagtaacgataacatattctactccttctgactcctgttatgatttgaatcattcatttttttgattgtttacttgatacaaactcagatgtatttctcacaccgattttactactgaattctgggttcttctctattttttcaatcatccgaattaaccttattctctgtgctgtatccatctgctcacctcattctgacagttctcccttttgatattgtcagtataaccggataacttttcaaaatatatacctaatacaaagaattgaacatatgtaattctcaattttcgaggaatatttaaaaaggcccagagggaattgttcccttctgagcctattggttatatagcagtatttttcatatttgctctgatttactttttttgtaatttcttctctggaaatcttcgaaccaaggtgcattcctcgttgcttacacatatacgctttcattgtttctatattctcatcagcacttcctgactcaagcgagcacatttgcgaattgttttcctcattatttacatgccacacttccagagcagaaatttgcatatgttttatgcataactattgttccatttgaaaacttaatatcaatatcatttgcagaaccatatctaactattttagctttcattccatttctcattatcttctctgtccataaccgttcatttttcaaagtacgcctcagttgcggaatcccaggtttacctatagctccgtgaataaaatcctcatattctctatctttcacaatagtgccatctttaaatttaacggtgatatgatttgcatcttttacttcaataatctccgcctcctcattacctctgttttgaatttttttatcccctatatgatttcttgcataacaggaaggcactgctacactacctgtactaaatctttcccatcttgtttttactatttctccattatcaaacttcactttgatatcattactcaaattatattcaatcacttctgccatcatcccgttcttcatttgttttcgtaaatttaatctttgattcttttttgccagacttgtatctttgggatgtgaaatatttcctttaacaaaactttgataacatttatgatatacaatttctccatcctcgaactgtacagtgatatttcgacaactagacattttaatgatttctgcaaccataccattattcatttttttcttttcatataaatgaatcgttgcacgtttattatttgatacatattcctttattgtacgtttatctttctcaaagtttataaacttatcatcctttttgagaacatctctgacaaaacttttcaggcaacattccaatgaagctgacataaatctactatcctctaaaatatagtttcttccactaacaccagaacatcccggttctctaaaacgataaagttttattcccaacttttcaactattttattctttccttcatcatctttatttttagtatgagaatattcaccatcatactcaatcgctattttcagcttatcattatataaatcaagctctttcccttctaaaccaactctgtcagaacgctttgaacgttgtggaattcgaacaaaccccaatgactctaaataaaatcttaataccaattcattttgtgatacatttcctccaggaattgtaggatgtgcaatactaccgatacaaaaatcccgccaggatactcccgttctttttcctccatcttcaaacaaaatatccatatcatgactccccctgtattcaataacctcagcagtcaatccattattcattacctttttctcgccaattcgctcttctctatttcttggagctttaaaatgtttttcatagttgaagtttccctcaataaagtatctccaattttttaacttcatttctttcccatcacaaaatctgattataaaattttcacaagtactataacttacaacttgtgccctctttccatccctggatgtactctctacccctattctttcacttgcttttgttatgtattttctcatttacacgcctgcattctaatttgctaagtgtttctttctaaaatcaaaaaatcctgttctgtacatcaaaacattattttttgacttcctttattatatttttctatataaagtaattcccagaatacttactgctatcacaataagaaattttccaaatcctgatattgtatattctagacctctcatacaaataatctgtcttctcctaaatatttttctagtcattgcaatataaaattgcttatacagtctctcccttaagagtcctggtattctggataatatacagagcgaccgatatgaccatcattatagcgcacaaaccaatcaacagatctgataccataggtgtaatgtggaaccatataatatgcaccgctgcagttccatataataaaaaggttactatctttccatgccagtctgcaccgtgtacttttcctgtctttcgtatcacaagacatccactgactgccatatacagctccttacctgccattattacgattaaaagaagcatatgcggaaaccgagtaaacagacagattaacatcgctgcctgtgtcagcttatcggccaccggatcaagtatttttcccaaattactaatcatatggaatcttcttgcgatatatccatcagcaagatccgtaagaccagacagcaataagatttctccagctaacagaggatttttctttacacaatagctccatataattaccggaatcaggcaaagccgaaaaaaagaaagaagattaggaaccgtaataattctattcaaattttcttcctgattcacttcactctgcatgtacggtcgcctcactttcctttttttttgacataaaccaataaaatataacacaaaatgctaatgcaaacacaacaccaaaaacattttgaatcactctaagactaaccgctccttgtagtccataagtctctgcagcaatggctaaagcaccaaatgtgttaaatactgcctgccagccatattgtgctgaaagtcctacaccgattccaccaagaattcctatatatgcatagattgacgaaggaagcagaaaatataatactgtaaaacatataacacctgcaatatttccgacaatccttttacggactctgtagtgcatatcttccataaacggcaaaatcgcggacatggccgcaataccagcccacattgcacgtggcatattacaaagttctgcaatgcaaaggacaatcggtacgcataaaatctgacatatctgccattttgttctggaagaagtgatatcaaattcttgtatcagatctttcagatttcttttataagttctgtttttatgatttcgatagaatacgaagcaggtaagtgctgcacctaaagccattccgactaatcgcatctgatagctttttcccgtaacatcataaccatatagcagcagatacccaagaaccaatgttgattgattaaacatgaatggattatggcatccgaacagaatcaacacagccagtgccgcaatatttaacagcattcccaataccggtgaaaactgatttgctaaatgcggacatacagtcataattacaaagaacaaagccaaaagcatcgtagattgtccggtgtggatccccagatccgcatttctaaacaccatgagacataataagaccactacacctacaatgctgttctcatttccaaatagaatgctgaaaatactaacaaagaaaaaacaaaatgccaatgtaacagctatcttcaccagatatacccacatatgatataatttttcttttagtgtttcactctttttcaacaggtttttagaacctgcctgatttaactgcaactcctgataaaatgtcatataaattctcccatcttctaatttatcttaaaactatataatctcatctttctgctttggcagctctataacaaatctgcatccaccatattcacggttttctgctttgattgttcctccggcactatctacaatccgttttacaagtgcaagacctaggccatttccttctgctttatgagatccatctacctgatagaacttgtcaaatattctggattttacatcatcctctattcctggtccttcatcttccagaatgaacttaacagaatcctgttcttgtttcagaaacatcataattgtcccctttgaagggctgaacttaatcgcattatccaaaagatttatccagatatgcataaaaagtccttcattcccagtatatttaacttcctccaattctacctgaaaaccaatttctttttctgtccattttgtttccaatgaaagaaatgcctggcggatctgttcatccagacgatattctgtttttttcattggtatattctgattctctaacttggataacagcaaaatattaccaaccaatccggaaagtctttgggtgttaaataagattttttctacatattcctcttggtccggagacagttcttctccctgaagcagcattgtatatccttcaatggcattaatcggggtcttaaactcatgagaaacattagatacaaaatccatctgcagcacctctgttgcacgaagttcttttgtcataacgttaaaactttgataagattctccaacttctgctatacggctgttcgtttccaaatgctgttcaaaatctccctgagaaacttccttcattgctttactaagtctggtaattggttccagtaactttgcattgataaaggaagtgatcagccctgcaatcaacgtattgaaaatcaaaagccagccaagcacagatatgctgcccggcagattaaaaaaatgattcaaaaaagcaaataataaagcagatatgactgttgaaaatacaagtgccagccagattgcaccagtcagacaggatcggatacgcaatccttttttttccttttgttccattattttttcaccaccttgtatccaattccacgcattgttacgatttcaaaatccgggttatctttaaaacgctctctgagtcttcctatatgtacctctattgtatgtggatctgcctccgtctcgtatccccatacttcatccatcaactgttgttttgtaaatgttctgcctggcgaagctgcaagcttatataaaagcaggaattgttttttaggtaaaacaagactttccttatcagttgtaaccgtcattgcatcataatcaaactctgttgaaccgatcacaattttgtgttcattcaatatctgtgcacggcgaagcagtgctccgactcttaaaaccatttcattcacatttaccggttttaccatataatcatcacttcccgaaaaaaatccctgacgcatatcatcaaaggaacctttcgcagtgatcataagcactggtatctgatatcctgctgagcgaagttctgacaccagttcatagccatccataaccggcatcataatatcagaaatgatcagatcaatatattccttatccaatacttctaatgcctgtgctccatccgatgcacttttgacttgatatccattcttctcaagcactttttggaatagctggcttaattctttatcatcttctacaatcaatatttgaaacacgttttccttcctccttattaaaacagataccttgcccatccaagcagatgctgtaccaaaaatatttttctctgacgtttctttgttaattcgattggctctacatgatatggatcattataagttccgccttctaatatctggcgggacactttttcatattccatcatgccctcttccaactgtttattaatatctttactgcgtattacaagcatcagttccgtatccagatatgcacttctcatgtccatattaaaggaaccgattacagacagatcatcgtcaatcagaatactttttccgtggtatgaataaccgccttcatattcccagatattaattcctgtacttaagattctatttctgtttttcgcataatcggcagacccaaatggattcccattattcgcaactgaatttgtcatgatagaaaaatctgaaacgttctctgcaatctcctcccatgtattatacatcatatcattacagataatatatggcgtgtggatcttcacacgattttttgcatttttcatcaattctcccaactgataccacactactggttctttggaacctgtgtgaataggatttgacactaatgtaatcttttctgtctcaaaagtttcgtccgcataatcggtctcgcagattctttccttattctcttcaaaatatttctgatagctgttctgcagctctaaaactgcgttctttacagattttctatttgccagttttttattgttatgaaaataaccactgtcttcctgattccatatggtttcaaaataatctgacaactggttaactgaattttctttctcaggttcatcgcaaaccactaacacgtctctgtcatagttcttatgtcccggaaaatcacccaggaaataattgtatgtatttcttcccccaagaatatatctctttccatctgcaatcaaatatttatcatgcattctacccatcattttccacggtttcaacggattggccttattatacagtttaatttcaacattctcatgggaagataatccatagaaatacggatttccttccatatcaatccagctctccattccatctactaacagacgaatatgtacacctctgtctgccgcatcatgcagtgctcctaaaatcaattttccactttcatcggattgaaatgcaaaagtagaaaaaataatttccttttttgcattcttgatcaaacgcactctttgtaaaagcgcttctggattcttttctatgattaccgcccgttctgtattttcactgcattcgttccatgacccattttttgtttcttttttggttgtattggacacttccggctgctttttatatgcaacgcagattccgagcaattcataaaaagccacacataataaaattgccagtataacaagaaggattttacatatcttatgctttttcattgtatatcacctgattccttttcatttcatacttatacaatacaaagtcaatctcaatttaacctcaacaaggtttgtttttttcatccatgcaaactgttgctgatgaagtcgatccggaacttctggcaaaagtattagcaaatgcagagatgcgagcattgctcaattcactggcaaagacgatgaagtaatgaaaaacacgattaaaaggcgggataaacactgcttctaaaggatataatataattgtggaatagaaatactcaacaagttacaaaaatctattccaatgtccggctaacatgttgatttttgaagtccatccggatatactagaatagaaaaatgcaacatgttgcaaaaatcttttacagtgaggttttaagatggagattcgcagagatttttatttggataaattgataaaaagaaagaataatggactgattaaggtaattactggtattcgtcgatgtggaaaatcctatttactgaataatctgttttatcatcatttattggaaagcggagttgatgctgaccacatcattcgctttgcgtttgattcagccgatgatctttatctgattggcgaaagcctgattcagattgaaaaggaaaagcgtggagttgaccctgaaaagttcatggcttatatccgttcaaaagttgtaggtgaagaaatgtattatctgttgcttgatgaaattcagatgttggattgttttgaagctgttttgaatggctatcttcgcaaagataatatggatgtatttgtgacaggaagtaatgcaaaacttttgtctaaagatatagccaccgagttcgccggtcgtggtgatgaggttcatatgtatcccctgagctttgccgagtttatgaccatttacagtggtgataagtacatgggattatctgaatatatgctgtatggaggtattcctctggttgttcttcgtgagggagcaaacgataaggcagtttcattgcagaatttgttcaacgagatttatcttcgagatattaccaaacgtaaccgagtgaggaacatcggagaactggaggatcttctgaatattctttcctctgccattggttcgctgaccaatccagaaaaattgaagagtacttttaggacggtaaagaaatccagaatcacttccgctactattaagaaatatctggattatttagaggattcttttctgattgaatcagcacaaagatatgacattaaaggaaaagcatatattgaaacaccaaagaaatattacttttccgatcttggccttcgtaatgccagaatcaatttccgtcagtttgagcagactcattctatggagaatgtaatttataatgaacttcgtatgcgtggttacagtgtggacgtgggtgtaataccgattgcagaaagaaatcaggaaggtaaggttgtccgtaaacagctggaagttgattttgtatgcaatcttggttcttccagatactatatccagtctgcatactcgctgccagatgaagcgaaacgaactcaggaaatcagaccgttcagaaaaattgatgattctttcaaaaagattgttattacaaaagatattgtacagccctattatgatgactatggtatcttgactgtaaacatttatgactttctccttgatccgcaaattcttgaaaaataaataatagtattctaatgagccaaagcaagagcttactacaaaaatcagataaatgggaggatgcgataagaaatcaccttcgtccttcgttatccttcgggattacagatgtgaatttgtggtgtggtaagataaaaacacaaacaaagagacacaaatattttccatggaaaatgaatataagactggagggtacatttatgttaaaaaacaagcttttgatttctggaaaacttatatcgaatttttgacgaaaggtatgattgatgttccgatgcctaatccggcaatagaattcctggctgatgtaaaggccggaaaatatgatgaaataagcgatgaagaatacgatgaactgctgaattctacagcagaacttgcaagcttctggaagaaaaaacgaaaagcaacggtaggcgaaattgtacgggaagctctaattcatatgaatttaagtcttagtgaaacagaaaaactggctcagattcttgcggaagcgtcaacatgtaagacatataagtaaaaagaaacattgatgggacgatataacacaagggaaacaataagggaaaatctgatgcttctgctattacaggacattaccgataaaattgcaagtcctttttatcggacacatcattttgcataattgacaataagaaaattctatagaactgaaagaagggatttttatggcggttaccaataatatccgagaaatccgagaacagcgtggcatttaccaagatgaccttgccgctgctatcggattcagcaccaaaactgtcggcaggatagaacgtggggacagcaccccatctgccgagtttatgctacggatttctaaatactttaatttattagtggaagatgtcttccatgtagaagattgagctgggtagatgccacccagctctttttatgtttgaatcgtcaaccttcaattcgattatgttttcatctccaaacacattttttcatccaatgcaatgttatattaaatgaaaaaatcatttgatatcataacaaaagttatattattctcttcttatatgtgcatataatcccaactataatgatagttatgtaataaagaatagtacgagcatttttaattttatcagctatcataattctgtatgcctccttcttccatgagattacagcaaacgtagtagtaatgtctatcaaaaggcttttacatattagataaaagcatgtaaaatttcttttacatagcttaattgcagtctatttagcttgtttcttgactactcaggaaaaatatttctaccctcgccccacctgtattttcagaatttgaaagtttaatacctccaccatatttttcagccacagtttttgcaaaaaatagtcccatcccataatgggcttcgccatttctacttgtgtcatccataaaaaactgctctgtgccatgcaataatgcttcttttgtaaatcctgatccgctatcctccacaatgaatgtcagccggccatcctgctcctttgcgtcaatataaatgattccattttcttttgtatgctccactgcattctgaatcatattcattacggcccggaacattggatcataagcaatcgttacctttttatcactttgtcccgccttccaatctattttctggtgatagatttctaccagtccgagtgcctgttcctttatatctgcgaaaaaatcttctaacctcaccgttgtataggtaacatcactgcaattccatgattttgtgacatctatcaactgttttacataactttgtatctgtgttgtgccgttcaaaacataagtgatattattcttctgttctgtggtcagttcagtctctgaaagtagttctgcatttccccgtacaatcgtaagaggtgttttaatatcatgcgccaaagcagacatctgttgtttcttttcctgctctgttttccactgcttttctaaagattctcgcaatgcatctcgcatatcatcgattgccgataaacagtcatcaaactctttgataccggaacaggatgtctcatattccagattttgatcctttatttgtctgattgcgtctaatacaggctgcatctgctttttgattctttttccaaaacgtatggacggaatgatgataatcgctaccgctccaatcactgacataatactcatcacattctgtggtcctataaaatgctccctcaaaaaagctgaatgatattgaggtgtcaggcgatattgcaatacaacatattcattttcccttacaattactttataaaaatatttcccggatgcgtttccgtactttgcaacattccatgctatctgttcgtattgttctgacagatctccacctattttctctccattctctgaaaagattacataatcacaaagtgcaggaatcatctcagcagttactttatccgcacgtaaaatcgtatcatatgcttcattaatcttttgctctgcataattcgccggatagatacagcccacactaatcaaaaggtacagcagcagccaagcaacaatcaccaaacctactaatgatccaagcatgaccagtacatatctcataaaaatccagctgagtgcattgcttctctttactcttcccatttatatccaatcccccagactgtttttatcggtgtataatcataatccgcaaattttgctcttatatttttgatatgcgtgataatggtactgtcattactctcactgtcaaaaccaaagacctcttctaaaatctgttctttcgagaaaacctgtcccctgtttttagccaggaattcacaaatttcgtactccgctttcgtaagaggaagttccttatcatcaaccaatagtttcttttgagatatttgaatacagaccctccccaaaaccatccggacagaatgttccctgtgctctcttctaagatgtgcattgatccttgctcgaagttccatcactccaaatggctttgaaatataatcatctgctcctaaagaaagtccgtttaccagactgttttcctccgtttttgccgtaagaaacaaaatcggacaatccacaagtgccctgattcttttgcataattcgaagccgtcaattccaggcatcataatgtccagtaaaatcaggtcataacgatgtaattcttccatattaatttttagtggattacttactttggtaaccagatgtccatccttattcaaaatgctttctatcatttccaaaattgccggttcatcatcaactgccagtatttttgccatagtttccctcgattctattccgatattctgtttccttcccagtggtttacccaccaaaaatagtataccatactaatccctgtaaatattaagcaacctggtatgaatgacaaccattcacctacactagtttctcccaatacagattgcagataagtatatggtactctacccgtccagcagacaaatacatatttccacacataatctccaagtccggtaagcatcaatgcactaattagtcctgatataatccctgctccaatggataccccttttccaaactgaaaagccagaatcagctgccacagataaagtggaacactgcttccccacagcagcaatgctgcaaatatacatcctttcatgatttcgatatcgcttgatgcgattcttccaaatccaattccgaatatgattgctgtcaataggatagagcacagacacaaaaccagtagcatcaacagtttcgataaaaatgctgcaggtttatccggtaaagacaacagattttgaaaatcacctgcattttgttcctgttccatcacacttgctgtaaaaattccaataagtaccggaagtcctgctcctattgcctgataaaatgcaatcactttcatattttcattccatggtgaaaaaaagtaatatattaaaaatataacgctggttataatcggaatcagtaagtgtgccagaatcacagatgttcctttcatctttcgcaagtctgcattaagagatcttccaatcatcttatttcacctctcttctctcaaaccatttcaaaaacagaaccgttacaaaaacaaaccagatgattgagagacacattcccggaacaatgactcccgtatccaaaagaggattccctgcttctgcggcaagtccatttggtaaaacatgaagcaacgggcacatcattcgcatagggattgcagaaacaagtacataccagattctggtttgtgatattaccacaccgctgacggtaataaataggcagacgaacaggtttacaatcattccaaatcgttcacttaaaaataaagctaccggaatctcccataactcagaaaccgtcagaaacaatactgcaatcaacgctcctccaactggaacatgtgtcgttagaagaaagcctccaagcgttgctcctgcaaacacaatcacattagaaaacaaaatcatgtacccaatataaataattttccccagcaacaattttcttctgtctgtgggaatagtcattaaatgatagtattttatctttttctcctgcgccacagaaagataacaaaatagagcaatcatccccggcagcaaaagtgtataccaccagttccaaacactttctgcataagcatttgtcatcccaagagtaaatataaatgccatgacaaatgtaagaagaggaaatccccagataaacttttttcgcatggttcttttggctttttgatgttctgcttttataatattaaccatggatttcacctgctttctggttttttcttaccacattcataaacaaatcttcaagattatctccctgctttaatgctccttcgtatcctaagattccacctgaaataatcccgactttatctgcaagtaactgtacctctgagagaatatgactggagagaattacagtgattccctgttccggaaaagaccggatcagctctcgtaattcctcgatgcctattggatctaatccattcgtaggttcatccaatatcaaaagttccggttctccaagcaatgccattgcaatgcctagtctttgcttcatccccaaagaaaactgtcctgctttcttctttccggtgtttgtaagtgatacaatctgcaagacctcatcaattctgttttcatctgtaccaagcaataattgtcttaccttcaaattctctctggcggaaagattttcataaataggcggattttcaattaacgctcctatttttgataaatctttcctatccaaaagttttccatcaaagtaaatctttcctgcagttggtttcatcataccggtcagcattttcaatgtggtagatttaccagcgccattcggtccaagcagtccataaatctgtcccttttcgatattaagtgaaacattatttaccgctttctgttttctaaaatatttacatagattttgtgtctgtaacatcatttccatctttactatccttccttctatatttcatttcttactgaaatataacctaacagaaaaaaataaagatttgatgaaggggctgtgaaaaaagcatagtcccgaaaaaaagaaggaccaagggtttattataaaccctaaggtccttctttctgttataattagcttgcaatgaaaattaataacataatctattctaacccaaaacaggcagttttgccactgctaattcaagattatctggacatctgtgatccagtgctgacttttgacaaatttatgggagaaattgaactggagaagtatctgaaaaatattccacaacattatacaggaagactcagatatgacccggtcagcatgctgaagacagttttgttcggatttatggcgaatggctatatatcattacgcgagttggaggaccagtgtaaagtcaatctccgcttcatgtatctcatggatcatcaaacaccttcttatcgtaccttcggctacttcattaacgaggtacttgctgattccattaaagaaatatttcaagacataaataaaaaaatcttcgagacagaacatgtggatctccaacatctatacatcgatggctccaagtttgaagcaaatgcaaataaatattcctgggtgtggaaaaaagccacagaaaaatccagataccgtctctttgataagattactacactctttgaggaaatcaatgaagaactgtcatgtacagggataaagctttgtatcaatagtgagtatgcacctgagtatctgaagaaagcgactgaacagtatgcagaagcctggcagattgatgaaacgatgtttgttcatgggaggggacatcgcaaaaccacgcagcaacgtcattatgagaaacttagggagtatgctgtaaaactagaagaatacgtggaaaaaatcaaaatctgtgggaaggaacgcaacagctactcaaagacagatcattcagccacttttatgcggatcaagacggactatatgggaaatgaccagctgcttccagcttacaatgtgcaggttggtgttgcggatgaatacattgctgttgttgatgtaaatcagtatcgctcagacatggattgttttattccgttgatgaacgagttttatactacatatggcttttatccgaagtatccagtggcagatgccggatatggttcttacaacaattacatcttttgtgaacagcatggaatggaaaagtatatgaaattcaccatgttcaagaaagagactactgacaggaagtatcgtgaagatccattccgagcggtaaattttccaattggtgaagacggaatcatgcgttgtccaaacgggaaaaacttttatcttcggtatcgaaaaaacgtaaagggaaacaagtatggacgtcaggaagaatactaccagtgtgaggactgttccggatgtccatacgcagaacaatgtaaaaagacagataaaaaccgtatcgttcggatcaaccgtgaacttacagcgatgcatcaggaagtaattgaaaatcttgaaagtatccagggagcacttctaagaatgaatagatctattcaggcagaaggtacatttggcatcatcaaaaacgaccgttggtacaaaagaattgtccgaagcggaataaaatctgttctgctggaagtatttcttgtttctattggacacaatctttataaatatcacaacaaacagaaaaaagttgcaactgccgcataggattccataatagctttcttatggggaaaggggagttatacacttttttatgaactataactactgttgtattcataagcaaaggacgcatgaaaaaactttcgttttttcacacgcccatcaattgaatatcattatcagaactcggctttccactgaaatcagcaaagctgttacaaatacgaagcgtgatacccagactgtccgtatcctgccaccccagacaagtggttaaatctccctgtgggtctgcatcaacaagtaatactttctttccctgcattgcaagaccgattccgagattgaccgaagtggtggtctttcctactccgcctttctgattgcagatggcaatcgttttgcagtttgacacttcttgcgtcctcctttcctgaatattcatagccattgtagaatgactatgtacctgaccgtttcatttcctaaacggtcgtggcaacatttgttctcaacaccccttgccgagcgtatcgctcatgggaagccactaaggaacagactgctgatctgtatcataggattctaacctctgccgggtactccgccagctccttagagaagtatcattatctttctgactgtcatcgccatgtcaggagcaacctgacactcataccgggagttctcgctgttctgcatccacaaaagttatggcgtacccgataaggtggctatcatcagaattaacgtcttagtgacctgtatattcagttttaaatttcaaaggaaggcgttccatttttgttgattggaattgctcaggcttttgacaccctattttttataaattttttttattatttttttgagagagattttagaacaatagataagtagaaaaaacttcaaatcccgtatataattaagaaataaagatagaaacaaattagaatttaaagaggaggaataatgcaatgaacttctttgaaaatactcgtaagccacaaggcttcggcggaaaattgatgacgaagatgatgaacatcggtcacgccaagttatcacaatggggattctcaaatatctcagtgaattcggacgctgcggtactggatgttggttgcggaggcggtgcaaatattgtagcctggttgggcaaatgcggaaatggacatgtgacaggaatggattattcgaaggtcagtgtggcagaatctcaaaaactgaacgccgccgccattaaacaagggaaatgttgcgtggttcaaggtgatgtctctgctatcccttttcctgatgcggtttttgattatgtttctgcttttgagacagtttacttctggccgggattggaaaaatgtttttttgaggtaaatcgagttctgagaaacggagggacattcctgatttgtaacgaatctgacggaacgaatgacgcagatgaaaaatggacaaagttgattgatggtatgaagatttacacatctgatcaactcattgctgctttgaaagaagcaggttttacagagataaaaacgtattcaaatacaaaaaatcattggataagtattgttgcaacgaaatagccaatttctagtttgtataacaggaaaatttaaatttaacgcttgaaaaaaggagaaataaacatggcaaagaaagaagaaagatttgaagttacatttagagacggaagtcagcttaaggatgaaggagttcgccaaatccttgtagataaggagactggggttaactatctttgttggaaatctggatatggagcggctattacacctcttctggattcagaaggaaaagtcatagttacaaagtaaaatcggtagttatggaggtgaaaaatgtatttcacagacgaaaaagactatattatgcgaatgataaaagaaatggtaagagtattattttctttaatgtttgggaaaaagtatgtttctgttgaacttgaaaaagaaaataaatatgaagtatcagggaaaaatttgaaagattttcttgatatgattgattctggggaaattaacgaagcagagaatatacttttagatagcattgattatacagacagaaatgaggtaatggcagcagctcttttctaccaataccttagtgagaaggatagtgagtttttgaaaaataataattatacaaaagaagaagtgatgtctggttttaagcaattacttatgcagtcaggatatactgatttgctatgtttggtcaaagctgaagagtaatgtagaaaattcaaagagataagagtgattggctgaaaggagaaattgtattatatgttctatattgtttttgactttatgatggcagtgattatgtttttgtttggaatgtggttttataaatcagaaggaaaagctactaaattcttgtcgggttataatatgaaatcagcggatgaacgaaagaaatacgatgaaaatgctatgtgtaaggcatatggaaaaagaatgatgtttatgtcagttccttttattattggaataatcatagatatccaatatcaaggaataggctgttggatcgcatgggggatatggcttattatgtttgttttgttgcttattgatagacataaaagagaacgttaaattcccatttattgggaagtcgctgagaacgaaaaatcgataatttgtggaggaaacaaacatggaagataataaatcaatgactgtcaagaaaacggtaaaatcaggaataacttttggaagtgcattagctatggttattagttatacaacgtggaagtctgtcggctgggcgatttttcatggattacttagttgggtgtatgtcatatatttccttttgcgctattaaattacaatttattgatttgttagataaatagtaattttttgaggagattaagttatggaagataaacaaatattacttgataatataagtaaagtgcatactactgaaatggggattgatagaattaagaagaatctaaaattgaatactaatgatgtagttgaattttgtaaaaataaaattttagataagaattgtaatatttataagcagggtaaaaattggtattgtgaaattgataatattaaaataactattaactcttatagttatacaattattacagcacatctaatcaaataaattccagttgatatttcacatattttaggaaatttaataactgttatatttgattatcaaattcttcgcaaacccttgaaaatactaagtttgtagcaagtgaactttcccttactctttcccttgtgttacattctcccattggtttttatgaaccttaatatgggaaaaattaagggaaagaaaatttcataacacaatataacatataacaataacgacatggtgaactgattgaaatgttttcgatatttaactttataactgattatcaaaagaaaatggagataagatacgatgagaacaatttatgcagaatacaacataaaccacgatagtattgatgtttacacaagtgccggatatatgcttcgcattgattgctgggaagctgaaaaaaatttaaaaaccacatatggatcagaatgtgcgcttacttcattggctgtggatgagcctttggaatatgcaagattatatcttgatggcaatttacagatgtgggtggatgcagaagattcattagaactttattaagcaagaagtgaaatattgttgtagatctatctcatttcttgagggttcttaagatgcaagatgattgctaatacgcattttacaatagagtttaatttttaaaactgtatggtggaaagcaagtctgaaatggcttgctttttgctttacaacgagggtggttactgtataatgaaatatgaagtaaaaagcagtaatttgatatgaagcaataaaggaaatacatgatggaaaaatataaaattctaatagttgaagatgatgttgatttgagagagggactttccttctccttttctggtgatggatatgatgtgacagagacagggacaaaaaaggatggtttacaagaaatcgcaaacggtggttatgatattgtatttttggattgtaacctgccggacggaacgggctttgaactctgtaaagaagttcgtagctacagcaatatcccaatcattatgctgactgctcgtgatacagaaatggatgagataaaggctttagaattaggggtaaatgattacttgtcaaaaccattttctctgggtgtattaaaagcaagaatgaagcggatacttcaagaaaaatctgaaagtacaaagattgttacaggttcattaagcatagaccagagtacttgtaaagtatataaaagaggttcagaaatctctcttagcaaattggaataccgtctgttggtgtatttgattgaaaataagaatcatatcctttctaaggagcagattttagagaagatatgggatagtgatggaaaatatgtagataacaatacggtgtctgtgaatatcagcaggcttcgtacaaagatagaggatgatgtatcgaaaccaaaatggattcaaacagttcatggaatcggatatatctggaaggaataaagagatgtggattacgatacttttagcagtgcttttgtgtttgtcgattggatatagcatatatcaaaaaagaaaaacatatcgcctgattgaccgtttgctggacagtgtgttaaatcgggaaatgattgcagcttctgatgtggaagaaggagaatattctgcccttgtcagtaaaatcaagcagatacaggaagtgcttgataatcacgtgaatagtgccgaacaagaaaaagagcaggtgaaaagtctggtatctaatatgtctcatcaattaaaaacgcccttagcgaatatttctctctatgcagaaatcttaagtaaagaggaaattacatcagaacggaaaacattgttttctgaaaaaatgcaacgacagattgacaagctgagttggattgtggagtctttatcgaagatggtaaaattggagcaaaatattgatggctttgaaggaaaagcaatagggatcaagcagacgattttagacgcagtagatacgctttatgagaaactggaaaaaaaggaaatcaactttacattggaaccatttgaggacagattactgtatcataatcgaaaatggacagcagaagtatttgtaaatttgttggaaaatgctgttaagtacaccgatagaggaggaactatttccatttgtgtaaaaagttatgatttatacacagagattcagattgcagataatgggcgtggtatccggcaggaggaaatgaccgatatattcaaacgattttatagaagcccagaagttgagaatatggaaggttctgggattggtttgtatctttctaatctgattttggaaaaagaaaaaggatatatgacggtagattccgagtatggaaagggaagctgtttttctgtgttcttacaaaactgtaagaactaatcatccgtttgtaaagaaattgcaagatacggcagttatactggatgtatcaagaaaagaggagtgatgacggatgagtattttagaattacgaaatgttgagaaaatatatggagaaaaagataatcaggtaaaggcactacggaatatcaatctaaaagtagaagaaggcgagtttgttgccattgtaggcacatctggttcaggcaaatctacttgtcttaatttaatcggtggtctggataatccgacaagtggacagatttttataaagaataaagagattggttctctttcaagaaaagaactgacgattttccgtagaagaaatatagggtttgtattccagaattatagtttaatgcctgtgttgaatgtgtatgataacgtggcattgccggttacatttgactgtggaaaacatattaaccgcaaatatatcgaagaattgttgcgggaactgggcatttgggagaaacgcaagaaatatccaaacgaattatccggcggtcagcagcaaagagttgcaatcgccagagctttggcaaataaaccgagtatcctgctttgcgatgaaccgacaggtaatttggactcagccacaaccattgaggttatggggttattaaaaacgagttgtcgtaagtacaatcagacgattctcatggtaacgcataatgaagccattgcacagacttgcgacagagtaattcatattgaagatggtcagattgttacaggaaagagaagatttccggcaaaaggcggtgatgtcgtatgttaaagctggcatggaaatatatgcggtattacaagagccagacatttgcaatttttgcgagtattttattaacagcatcattgctttccgggatttcttctttgatttacagcagtcagaaaagtgatctggcgaacagcaaaactatttacggagactggcattattatattgaaacggataaggaactttttaattctgtagaaagcggtgagaaaggaaaaggatatacgctggaacagtgtggaaaaatggaaatccgtgacgttgtggcagaagaatttatgatctgttttatccatgccgatgaaacttatcgtcaaatggcacacagagacttgttggaaggaacattccctgagaaagaaaatgaaattgcagcggatggatttgtgcttagtaatcttggattttcagggaatttaggagattcccttcgcattggtgaaaaagagtatattgttactggtgttctgaaaagcgaatgggcggcaagttccagtgaaatggaagtttttgtaagtgattcttttaaaggtcgaggaagccagacgtttttatatctcagttttaatgaagatgagaagttatataaacagttggatgcttttttacaggaacataaattatcttctgaatcggtagcagaaaatgatgaagtaatacagtatcttggcggagaagcaccaagcagcatttctgaaatcgtgaaatttggtctgtttgaagaagaaggaaacttcacttatatcgttttgaaattgcagagcgactacaatctggcttacaacggaatgattttcctgttatgtctgttcagtcttttcgtagtttacagcgtattcagtatttctgtatcgaagagaacttctgagtacggaatattacagacattaggtatcagtgaagcgcagattggtggcaccttacttttggaactttggacgttatttttcattggatatccgttaggatgtcttttaggaaatggtgttttaagccttatgtatcagaaatttagcggtgtatttggtggaaaaggaatcagtggagcagggaatggtctttctgttgcggaccatacgttagcagaaggagaaaatacagtagagttttttgtttcaaaggaagctgttgtgtttggttttgtatttctactgatttcgttagcactcgttgcctttctcgtggttcgttccatgcggaaagattcgctgaaaactgtgatgagtggagatacttcttttgtaaaaagaagaaaaatatacgctatgcgaaatgttaatatggcaaatgtagtggtgcggaaattcatgtttgccaataaacgaaaggtaatagggattttattatccttgtctatcggcggttgcattttcttatgtaccacctatatggtagaaaatttgaaggttcacgcagaactttcgctgatatcggatgatgggcttggttctgagtaccgtatttctttaaaatctgactcgctgaaggatacgattccggaggcggtagcagataagattaaaaacatgccggaaacagagaatgtatatgcgacaaagtatacgatgggggaattacagatttccaaaaacgaatttttgtcagaagaagaatggagtgactatttcaaatatcaaaatcaggagccgtattatatccagagatatgatgggatctgtaagcagcaggaagatggaaattatcggattaaatataatgtgtacggttacgatgaagcgatgatagaacagcttcgggattttattctggagggagagattcagccggaaacaataaagaataataatcaagtgattgtgacggcgaatatggacggtcagggaaattactttttttatggaaagaagccgggcgataccattactcttcgagtaccaaagacagaaaactatacagatgaactgttaaaattccaaagtggcgaagaaaactatattgaaaaagagtttgagattgcggcaatcgtaaacagaccgttggcgcaggagaaagattttctgaatacagaagtctggaaaaatgcgcagagtgtgattatgacaggcgaacagatggaagaaaactttggaattacagattatagttttatcaatgcatcgccggctgatagtgcggatgcaaagatcgtgagcaatcagttattacaagtaatccgagatgttcccaaggcagtattgcaggattatacgaccgcaattgcaacacagaaaggttatcttggacagcagcagatcttcttttccagtattgcagtgattctgctgattatcagcctgttccatatcgtaaacagcatgagtcatacgattctgaccagaagaagagagtacgggattatcagagcaatagggattacggacggcggattttacaagatgattttacagacaggtattctgtatggattgttggcggatgtatttatctatcttatttataacagagttcttcgcagagtgatgaattattatctggctcatgtgctgcagtttttacattatactactaatattccgaatctggttctgaatggaattatggtgctgaatgtagtgattgcagtagtggcagtaatgtttccggcttggaagatgggaaaagagaatatcataagtgagattagaagatagatttataatcaggatttttagaatttctttagtggttagtatcattggatatagcaatagaattagagagaatacccaatctttataagtaaccagagggcgacagtaaaatactgccgccctttcttttatcggtttgtccagtaaagagtgttcagataacaccggattccaagatatattccctgtataaataataaaagaaacaaaagatttatgggcattacttttttgattgattctccaaaataaatgatgacaacagcacttgtcagtatcattagtagagtaataacatcccaacagtttttcttatataattctataatctttatttctatcagtatcgcaagtatccctgttcctgctacgtatattccaacaactaatatcagcaataaccaatatatgattccggctataaacgcattgggaatttttgtactgatctgtgccacagattgcccagcatcaatcgtccatccgataaaagtttgtatgaatgacgctgcatcatggaagaatgatttacaatcggaaaggagcacatctgactgtactgcctgaaaaagagtggttgtcagcgaataccatgcaagaaggaacaaggttgtttggaacattaccgtttttgctttatattgtcctgcaagtcgctctttttgtgtttcgtattttgcttttgcattctgatagtctgtccggtcacaggcttcacatttttcatagagtaccggcttttctaccggtatctctacgattttctgatgtgtccgggcataatcccgttgttgtgttaagcatcgtattttatcttgacattccccgatcatgacgtttgcgcttcgcagcttctctttctcgatctgcaatgctctgtctgccagcttcaagtcgttctttaatgcttgaatattcccggctttgttctctttgtttaatttctcgttcaaggtcagagattcgctgagctgcgtcttcagttcctcgataagctggtctttctgttccagttcttcttgtatctcctcggtcaagagcagaagttcttccaactgttcggcgttctttgattctctggattcgttcatctatatcacgtcctttctctatctgctgttccagttcagcaattcggtgttctgtttcagcaataaactgttttcgctgttcagagtctgtgccaatttctgccattgctgattttcgttttccaaaagttctatcttcgttttctgttcttccatcttggaaagcagttcctcggtatttggcaaaatgttgagcagctcggataactcgctgtttaatttttgcaatttctgattctgttcctgcataagagagagttgggtgtcccggttctgcatttccagaatcatttctgccattaaggtctgctgttcttcgatttgcccaatcatggattccattaagggtataatttcccggctttcttctaatgtcatttaatcgctccttccataatgataatgcacccgatacttttccaaaggtgtccagtatcttttgcaataacgtgttttgttgttttatgatttgattttccgctactttccacgaaccttttatttcctgcccggcaagaaacttttgttcaatctttcttgcgtcagcgccttcatggatggtaggaatctggagttttccctgtttttcataagaacggtgatcgacctgattatgcaaaggaagatgttcattacacacctttgcccattcactccgccacagttcacaattttttggattgttccatccggtagcatcggtcagcacccgtttccattgcaggcggtttcttgcacccatcttctgaattccgttttcgtctaatacagggatacggattccatgacggtcagggtttttcttatcctgccaccagttcggatgggattcatcaatcacgatatttccgtttttatctctgagaaaatcccaatccttgacttctttctttccccaagaatgatccgggttaaaaggacgcatagtcagaagcagatggacatgggggttgccatcccctttatcgtggatactccaatcagcacacattcctctatctacaaaagttttttgaatatagtcagttgtatattgaatttgttcctgtctgttccattctttgggaagggcaaattcaaatgacctgccaagttgggcatctgcatttttttcaatcttcaatacctcattccataacctttgtttctgaaatgtgattttaaatttttctaaagcagcttctttatcttctgatcttttgtatcggacagatttttgaaagcgttttatattttcttctggtactatctgccattcaggaggtgcgttttcacacatcatcagccgagtgtagaccacttcttttttagaagtgtaataactgattctcccggtttcctcgtttttcatcacatccccattgagatatgcggaagcggagataacagatttccctttacttcgtccgactattttgactgtgtaatgaaaaatcgccatgtctggattcctcctttctgcacatccggcatagatttccggcaacattgctttcggttttaggaaaagcagcattgccggaacgccctctgcgtaagagtgccctgcgcatagcagcctgcatggaatgcgcctctctggcgaagagtgcctcctgcggcatgagcaggtctggctgaaagccccgccgacggaacgagcccggcaagcgtgaacgcagaccggttgccacttgtggcaaacttattgggacgacctctggttgtccataagtgcgcccttcatgaaaaagcaatgaagggaatgaaaaactcatcccctccgccattacacttcctccatatcggtattgacttctttctgcattgcctttgagaaaaatttcccgttggcttcctgccttttcagaaaaccaatcagctttgggatgtcttcttcctcaataggcgcaccgagaacggattccaccgcaccgccaatctgacagagcctatgggttcgttttttactttcttcggctttctttcgcttcagaagttctttcttctgtgccgcatatcgtttcgccttttcaaggctttcctgctctttcttttccatttcaagcattcgtgcttcataactttttgttgattttgccattcttacattctcctttccttcacaaacataagttcttggttgcgtatcagaagaagcacatggtataatcttcttgcgtgtaggtatatcatggcttcggtctgatagaacctttggcggtttcttgggaagccgcctttttaatttgccgcagttcttgttacggcttttacatttcctctatccctcaaatcacgaccttcattcgcttccataaacatttccagaatatcggttttaatcaggactttacgaccaacctttaataccggaagtttcttccattctacaagctgtcttaaggtgtttctgccgattcccgtatagtcggcagcttcttcgatggataatgcaatttttctttgcgtcatataatcacctccttataaattgcattatgcaattcctgtgatgtaagtatatccttttcacatctttttgtcaagcgttacgaaatgttaaaaataaatattgcattgcatattgcaatttcggaaaaacaatgctataattcatacataccgaaaaaggaggcagtcagcatgaaagataaagaattacgcaagctgataggcagcagaataaaacagcgccgtctggaattgaatctgacacagccttatgtcgcagagaagatgggagttaccgcttctacaatcctgcgttatgagaatggttcgattgacaatacgaaaaaaatggtgctggaaggtctttcggaagcactccatgtatctgtggaatggctcaaaggggaaacagatgaatatgaaaccgacattacggataagagagaattacagattcgtgatgcgatgggagatattctggaacagttaccgcttgcccttaccaaagaagaagatgctttttcaaaagatttattactgctgatgttaaaacaatatggtctgtttttggattccttccagttcgcctgcaaaaacttcaagggaaatgctggtcagacggatattgccaaaacaatagggtttgaatcgaatgaggaatataatgagattatgttcttaagggaaatcactcataccatcaatgcttttaatgagatggcagacattgtaaggctctattccaagaaaccaaaaacagcagaacaaaggcttgcaaatcttttatcagaagtcttatacgaagattccgaatcggtatagtaagacaaccggagttatgatatacttacacgcacgaagcatttcatcagttccgattgtctaatatcgaaaggagacatacgattatggcaaaaggatctgtaagaaaaaaaggaaagaaatggtactaccgcttctatgtagaggacgcaagcggcaatcttgttcagaaagaatgcgttggaacagaaagcaaaagtgaaactgaaaaactgctccgtcaggcaatggatgattatgagaaaaagaaatttgttgccaaagcggataatctcacagtcggacagcttttggatgtgtgggcagaggaggaattaaaaacaggtacgctcagcaatggtacggtggagaattacctcggaacaatccgaaatattaagaaacacccattggcagaacgtaaactgaaaaatgtaacctctgaacatttgcaatctttcttcgatttgctttccttcgggggagttcatcccgatggaaaagagagaaagggttacagcaaagattacatccattctttttccgcagtcatgcagcaatcattccgctttgcagtatttccaaagcagtatattacgttcaatcctatgcagtatattaaactgcggtatcagacggatgaagtggatttgttttctgatgaggatatggacggaaatgtccaaccaatttcacgagaagattatgaaagactgcttgcttatctgcaaaaaaagaacccagccgcaatacttccaatccagatagcctattatgccgggcttcgtattggagaagcctgtggtttggcatggcaggacgtaaatctggaagaacaatgccttaccataagacgcagcatccgatatgatggctcaaagcgcaaatatatcatcggaccaaccaagcggaaaaaagtaagggttgttgattttggagatacactggtagagattttccgtaatgcccggaaagagcagttaaaaaatcgaatgcagtacgaagaactttatcacacgaactactacaaagaggtcaaagagaaaaacagagtgtactacgaatattattgcttagacagaacgcaggaagtcccggcagattataaagaaatttcttttgtctgcttaagaccggatggttgtctggaacttccgactactttggggacggtatgcagaaaggtggcaaaagcattagagggatttgaaggctttcatttccaccagttacgtcacacctatacaagcaaccttttagcaaatggagcagccccaaaagatgtacaggaattgttgggacactcagatgtcagtaccacaatgaatgtctatgctcactccacaagagatgcgaaacgaaaatcggttcggcttcttgataaagtggtaggtaatgactaaaaaaattcccttatttcccttgtgattatctcataagggcaaaaataagggaaactacatatcatttcactaatggacaggcggaaaggcctgtaaaatggggaaagttagaggaataattatataaattccagtttgtatggataatattcccataaaaaagaccgcttgcacttcggtgtaggcggtcctcttatattctgggcaatttgattagatgaataaattatgcttcttcttggctgccaataccttgcagagaacatcatccactgcgtcagtatatctgccttgttcgagaagctcatttttcagccggataagtgactgaataactctgctctgttcttcggctgttaagtaaatatgatatttcttttctctcattggctgttcctccagttctcaaatacgtttctgatagtcccgacatcttcttccgtatcggaagtaataaatatatgtacgctttgaaaggctgctttgatacgctgagcataagcgatttctgtttcattggttttcataggcaacttgatccgtttaattcctctttgctgacagagatgttcttttaagatttccatatcttctgaaccgctgttcacttcaatcgccacctgttcagatggaatataagtatcaagcggtatccctaaaactctgtctgagccgagttcgattttcaatcctttcatatgtgaataataactgagggcaaaagccggaaacactgataaatactcctgctcacatatcctgcaaccttttccgagaattgtccgttcattgatcttcatactccatgaatgtccgtgtctgcatttccaccatgctcgtttagcagaagttcgtgatacttctgtcggcttcaatttattctgttcataatcccattcactgagaagctgactgtccgttgtcgccaaatcattatatccggcaaggacttctctctccgcacaaacggggcataccgtcgctttcacacgggcattgataactgatttccactcgttaccgcatttactacacctccaccagacattttttctcgcctttgcatttacttcatcaggcttcaatggcaagttcttctccgaccactccgaagcaattttagggtgtgttgtctgcaaatcgttaaaccctttcatgaatatgtacccactgcaatacgggcatttgctcccaccggaacgggtagaaataagggtgttccactctctgctgcaatccttacacttccaccaagccttacgattggcaaagaccgtaacctgagttggaagtaacggataatttctgtccgaccactcggcagctatatccggcagaagtgttgcaaggtcattaaatcctgccaacactttgttatgggagcaatacgggcaatctgttttatttattgtcctgctcttaacgtcagcttcccactcgtgtcctttctcacatctccaaatcactttcttatgagaaccaatagaaacctctgtcggttttatcttattctttttcgaccactgttttaccagtaatggctctaatgtcgccaaatcgttaattcctgcaattactcttgcaccagagcatatcgggcagttctctccattagaacgagccttaacgcttgtctgccatttgtgtccgcaagtacctttccaccatacttttttatttgaaccaaaggtaatatcatcaggtgtaagcggtaaattcttctccgaccattccgtaataagctctgggtgtacttctgctaaactgttgttcatagccaaacctcaacctccttgtgcttagagtatatgaagttttggctttatcttgtagtttgcgaatatccgtataaatagaaaaagccctttgagaaagggatttctcctctctcaaagggcaagttggcaaacttgaagttgtttagttcttgctatggtgttttaaaatacttttttgagtgtttttaacatctgcttttagacgttctacattatcataatccaatccaaattcaaaaatctttttacctttttcatcatagaaaacagtcactttatcataactgtagacaggtacaatatcttcaagatataatcctgtattatatgtttcggtttgagtctttgatgttctaatatcagacatacgatattctttatttgtaaatccaatatgataaactactttccctttatatatttcaactcgtttcgtagctgcgacaatacctaagattccgaaaatgaaaaagattaatggtataagtaatgttcctaaaaatgtgtaaaaaccgaattcttgttctaaaacatagaaaataacagttagaattataaaaatgctacttataagtatcattgtgcatcctgcaattataatgaaaatttttcgaccttttttcatagcaatacagtatctatatgcatttaaattttccatatggtttcccccgcaacttccgatttgtatttctgtttgttttaaaaatgggcaactccgattggaattgcccactcattgcactaattatgcgattttttcttgcttgcaccgatttctgtatcaaatgatgtaagtttgatgtaaatcgctgtttttttagttttttatcaaatgaagtacgtcccgtctattcggtgaaacggtacatctttacatcatcttaatagagctttgcacctgccggaattctgtcatctaccatcagaagatgaagcttttcttcgccttcttcttcgtgaatagcactgaggagcataccgcaagagtcaatgcccatcatcgctctcggtggaagatttgtgatagcaataagagtctttccaaccagttcttcaggctcataataagcgtggataccgcttaaaattgtgcggtctgtgcctgtgccgtcatcaagagtgaactgtaaaagcttcttcgacttcttaacagcctcgcaagccttaacctttactgcacggaaatctgacttgctgaatgtatcaaaatcaacaaattcctcaaataaaggctctacctttaccttagaaaaatcaatcttttcagactcagtttttacatttttttcaggtgcttcagaagctgtattatttacatcatttttcttatttacaccatctaaggacttcattgtcgggaacagcagcacatctctgatcgcctcagcccctgtcaacagcatacacatacggtcgataccgaatccgataccacctgtaggcggcataccaatttccagtgcgttcatgaagtcttcatctgttgtgttggcttcatcatcaccctgtgcaagcagttcttcctgtgctttgaaacgttctctctgatcgatcgggtcattcagctctgagtatgcatttgccatttcccatccgttcatgaagaactcgaaacgttctacatagtccggattttccggtttcttctttgtaagtggtgaaatctcaaccggatgatccataacgaatgtcggctgaagaaggtgttcttctacatattcttcgaagaacagattcagaatatcaccttttttatgtctttcttcaaattcaagattgtgtgctttcgcaagttctcttgcctgttcaagagtttctacttcgttccagtcaacacctgcatatttcttaacagcatcaaccattgtgatacgctcgaacggctttccgagatccatctcgattcctttatatacaatctgagtagttccaagaacttcctgtgcaacaaaacggtacaggttctctgtcagatccatcatgccatgatagtctgtgtatgcctgataaagttccatcagagtgaattccgggttatgtcttgtatcaagaccttcgttacggaatacacgtccaatctcatatactctttccagaccaccaacgatcagtctcttcagataaagttccagagagatacggagcttcaggtcttcgttcagggcgttgaaatgtgtctcgaacggtcttgcagctgctcctccggcattctgtacaagcatcggagtctctacttccataaagccttcatttccaagatatttacggattgcagtaaggatcttagaacgtttaataaaagtatcctttacttccgggttcatgatcagatccacgtatctctgacgataacgggtatctgtatttgtcagtccgtggaacttctccggaaggatctgcagactctttgagagaagctttacagcagatgcatgaatggaaatctcccctgtctttgttttgaatacttctccttcaagacctacgatatcaccgatatccatcttcttgaatgctttatattcttcttctccgatactgtctcttgctacataagactgaatatttccctgtaaatcctgcacattacagaaagatgcttttcccatcacacgtttggacatcatacgtcctgcgagtacaacgtgttttccttccagttcatcaaagttgtctttcacttcctggctgtgatgtgttacgtcatattttgtgatctcaaaaggattctgtccgtttgcctgcagttctgcaagtttctcacggcgcacctttcttaaatgattcaaatcctgttcctgtccattgttctgctgtgttgccacttttttcactccttctctctgctgtataccatcttatactgaacgattgatcttcagtacttcgtactcaataactcctgcctgtgtctcaactgctactacgtctccgactttcttaccgatcagggcttttcctaccggagattcattggaaatcttaccttccaggctgtttgcttctgtagaacctaccagctgaaatacgatttcctcttcaaattctttatcatatacatctactgtacatccgatgttgatggtatcaagatccacgtcatcttctactacaacttctgcattcttgaggattttctcaagttcttcgatacgtgcctcgatatcacgctgctcgtcctttgctgcatcgtactcagcgttctctgaaaggtctccctgttctctggcttctttgatctttcctgctacttcttttcttttcacaacttttaaattttcaagctcatcttccagtttcttaagtcctgtataggtgagtaatgttttctttgcttccattataattctccttacttaccgacaaatcattttctattcaagccgcagatactgattttatccgcatttaaagctactttcacaatttcattattatacatatttccagcggctgtgtcaacaattctttgctggtttaatatatgcaaaaacgcattctctcatgcgaaagaacacgttttatgtctatccgattttttccattaaaaggttctccagttcttcataactttccacctgattgatctcatctctgagcttcgcagaaccctgcattcccttggtataccatgccacatgcttgcgcatttcacggattccgatataatctcccttgaactcgatctgcagtcttgcatgacgcagcattgtttcccggatctggtctgtgcccggtctttccggaatggatccggtctcttcatatgccagtaattccctgaagatccatggatttccctggcagcctcttccgatcatcacaccatcacagccggtctgctcaaacatatccagtgccttctgtccgcttgtcacatccccatttccgattacaggaatcttcactgcttctttcaccttacggataatctcccagtctgcatttccggagtaatactgttctctggtccttccatgtactgcgattgccgctgcacctgcttcttctgcaaccttcgcaatctccggtgcattgatacaggtatcatcaaatcctttgcggatctttatcgtcaccggtttcttgatcgctctcgctgtcttatatacaatatcatagattcgcttcggatccttcatcaacgccgaaccttctccattgcgcacgacctttggaaccggacagcccatattgatatccaggatctgaaatggaagttcttcgatccgctttgcctgctcggcaatgatgtccggatcttccccgaaaagctgaagtgataccgggtattctcttggatcgatcgcaagcagcgccttggtattcttattcttataccggagcgcctttgcactgatcatttccatgcacagaagccctgctccctgttccttgcataacagacgaaatggcaggtctgttacccctgccatcggtgccagcacataacggttcggaagctctacatttcctatcgtcagtgtctttatcattcaatctcttcccccagaaaaaatactttgtaataaagctgaagctgtgtcagaagttcctgcttcttctcgtctgtctgaatctccttgatcttcagacggcttccgatctcgtcaaacatcggatctccctctgcagaagtcacttcaaattccagctccccattctcctcaaatacaagtgtaaggattcccccgacatcatgtacatacagcacacacatgatcttcaattcatctttgatgtgctgtggcagattatcaaaatccggattcatataaaatttttcttcgtaagagttggctccgcataatacgatcttatcctgatacataaattctccttctatacatacccataaattccacgtaccgaaacttctccggcaaagacagactttctgctgccgtcttcacattctacctgcaattccccggtcttgtcaatccccagtgccagtgcatcatattcatgttccggttccagtacacgcacccgacgcccacagtttaccagcagacggttataatcttccatgatcggctccagacttcccgcctcgcagaccgcttcgtaggctttttcaaaatgctccataatcgcagtgatcagctcaaacctgcgaaattctttgcccgcttcgatccgcagtgaagtcgctgtctttgcgatatcttccggaaaggactccatattgacattgattccgattccgatcactacatgattgatgtaatcgatctctgcgctcatctctgtcagtatcccactgatcttctttccactcacgaccagatcattcggccatttgattcctatatccaactcggtcttttcacgcaaagctttcgttgccgcatatgccatgacaagtgtcaacatcggtgcatctgacggattcatcacaggtcttaacagaatcgacatggaaatactgctgcccgccggtgattgccagcatcttccgcgtcttccttttcccgccgtctgcgtctctgcaacaaaaagagttccatctgcacctccggcctcgccaagtgctttggcccggttattagtcgaatcgatctcgtcataatactccagatttttcgccatccattttgtctccagacagctttttatcgcatccgcggtaatccgatccggaatatccacaatgcgataacctttgtttctcacggcttcaatctcatagccttcttcttttaactgattgattgctttccacacagcagtcctggacacctgaaagtggtcacagagctgctgccccgacagatacccatcgctctgccggagcatctttaatatctccgctttcatgcttattattcgttctctcctaaagttgcaaccataactgccttgattgtatgcagacggttctcagcttcatcaaatactcttgactgtggtccttcaaatacttcttcggtaacttctttttctttgatcgccggcaggcagtgtgagaagattgtagtatcttttcctgtacgttccatcagagctgcatttacctgatatggctttccgagacgctctctttcctgctctttcttttcttcacccatggaaatccatacgtctgtgtaaatgacatctgctccctttacaccatcaaggtcatcggtgatctcgatagttgctccggattcttttgcatattcgtcacatctcttccacagagattccgaagtccagagtggcttcggtgcaacgattgttacatctactccgattttggcgcatcctaccagaaggctgttcgcaacgttgttgcgtccatctccaaggtatgcaaccttcagacctttcaggtgtccgaattcttctttcatggtaaggagcatagccagacattgtgtcggatgtgtagtatctgtcagaccattccataccggaattccactgtactctgcaagtacatctgcgtatctctgttcaaatccacggaattcgattccatcgaacattcttccaagtacacgtgctgtatcttcgatactctctttatcgcctaactggatctcattacctgcaaggtatgtcgggattcccccttcatcctgtgctcccacggtaaatgcacatctggttcttgtagatggcttttcaaaaataagggcaatgttctttccttccaggctgtgtcctttaattcctgcttttttctttgcctttaattcacctgccaggtcaacgagatattcaatctctgccggtgtataatcttccagtttcaaaaaacttcttccttttaaattcatcttgtagtcctttctcagctttgcaatcgcatggacgaatttcggcagtttttcttttccctcatctgtacgagtctcgtactttctgctcgtctcattccacagttcatctgctgtataaatattatattttggaattctcatgagcttcgcacttgcctccagcattccatagaacaactctctgtctgaacagccgatcggcaacttgagtttgaaacgatattccgtcttttcaagttcgctcaaaagcttcattatttctacataataacactcttctcgtgtttcttcaatatagtaaatcgatccagtgagcccgtaaagcgctctttttgcatcataatagccaattttcaaattctgtctgctccgctttgccgaaaattcgagaatactgccaagtcctactctcggttcgatctccagcagagagccatcttccggaatcgtcgtcttcggcactcttcccggaccaaagatccttacctggatcagatccttatatcccctttttagaagagacgcggtcggcacattattgaccgcaccaccatcaatatatgtcttgccgtgcagcggttcatttttaaatccaagcagatatgcgctggcaagaagaaaatcctccagaagaccttccggtatatcttcaatactcagatccagttccttcatatccgatacagaaaatgtcaaaaggcagaattcttttccgcatttcctgatcttttcttcgtctacaacctcatggatcaattccttaagcggtgtaatatcaattccaccatctgcaagcttcttccagagacctttcaaaatctctcttatggatgcctctccatcaaagaactgttccatcaactcatcatccacatccataacacgggaaaatgccatctctttccagatatgtcctgctttctccagatctcccatacaaacaagggcgccattcagagcgcccacagaagtacccgctactgcactgatcttcacaccagcttccgaaagagcccgccacgcaccgatctgatacgcacctctggctcctcctccatcgaatactaagccatattctttatttaaatcgattatcggtttcatcaaatcacactctcctttgcgcttgatttcccctcatcactaccgtcgctgtcttgccgcctcgaacatcagaaccgaagatgcaaccgccgcattcagtgattctacctctccacacatcggaatcttgatataacactctgctacatctgccacttcatcccgaagtccgttaccctcatttccaattaaaaatgctgtccctcttgtgtaatcctcctgatcgtagctgttctttcctttcagatgtgccgcataggaatgaatcccggcttctgcaagtacttccagagtttccggcaaatgctctacatacacaaacggcattcggtaaaccgatcccatcgttgaacggatcaccttgggattgtaaatatccacacagtcgtgactcatgatcacgccggttacgcctgccgcttcccccgcacggagaatggttcccaggtttcccggatcctgcagattatccagcaccatcagaagcggtttccttccctgcgcatccagatccagcatctcacatatctcacagctcctctgctccatcacaagcaggatcccctgtggtgtctttgtatctgacacgtgggaaaatacatgatctgacaggatttccatctgtcttccccatgccgaaagtcccagctcttctccatatcggctgtaaaactgctccgatacataaacctctctcacctgcgcacgcggagcttcccggtacatccggatcccttctacgatatagacgccttcttcatctcgtgcctttctctttttctgccatgtaacaagctgttttaccctggcatttcctgtactggttatcatactgtaatctctttccttttattcttttcattacatcttgaaacgatatcccacaccccagattgtctcaatatactgtgggtttgaggtatcatattcaattttctcacggattttcttgatgtgcacagttaccgttgcgatatctccgatggattccatatcccagatctcgctgaaaagttcatccttggtatatacatggttcggatgactggcaaggaaggtcagaagatcaaactcttttgttgtaaaattcttctccactccgtttacccacactcggcgtgcagtggtatcaatcttaagtccacggatctcgatcaccttattctcttccacggcacttccgatcagccgctcataacgtgccagatgtgcttttacccttgccaccaactcgcttggactaaacggcttggtcatatagtcatcagccccaagtccgagtcctctgatcttgtcgatatcatcttttttcgcagataccatgatgatcggtgtattcttttccgcacgaaccttacgacaaatctcaaagccatccacgcccggaagcatcagatccaggatcaccagatcaaaatcaccgaaaagcgccttatcaagccctgtctgtccatcatttgcaacctctacttcaaatccactcagctccagataatctttctccagatctgcaatactctcttcgtcttctacaattaaaatcttactcatttatcggtacctcctgatattttctgattacaaaatacatcactgtgccaacaccttcccggctggtcgcccagattttgccaccgtgatcttcaatgatcttcttcacgattgaaagaccgattccgcttccgcccttggatgaattccttgaagcatccgtccggtagaaccggtcaaatatattcggcagatctttcgctgcgattccttttccgttatcctcaagctctacctgaataaaatcacctacgtcttttacccgcagattgatcagcccgtgctctcgttccatgtatttcaaagaattgctgacaatgttgttgatcactctctttaactgttccggatctgcaatgatcttctgatcaccctctacataattgaaataaccaaactctacattctttgaatccagctccatctcaatatcttcggcacagtcattgaaataatcgttgactgaaagcggtgcaaagttgtacgggatccggtttgtatcgatcttcgcatataaggtcagttcgttgatcagcgtatccatctcattcgccttattataaatggttccgatatatttttccatcttctccggcgtatctgcaaccccgtcacggattccttccacatagcccttgatcgctgtgatcggcgtctttaagtcatgggaaatattgctgatcagttctttgctttcccggtcactcttcagcttctcctctgcattatctctcagacggatccgcatcttttcaaatgcctgcatcagccgtcccatctcatcatctttttccggcttgatctcaaaattcagattgccttcttctacgttctgcgctgcttcctgcaacttgtgaatcggactgatgatacttccataaatccacaccatcatgatcatcgctgtaaatgccagaatcaggactactgcgatacatgcgcttataataaactgctggatctccggcatatctcccagcactctgatggattttgcaaaatctttatattcctcaccggtaattccataagtatgctcaatgactccgatctgataacgcgcaattccaaatataaatgccgttgtcaggatagtcggtatcatgatcatcgtcacaaaagaaatcaccagtttcgtccttaatttcatgctatattcatcctccattcatcgtgcacgcccggttatgagttccgtatggcgctcacgcaagtctgcctgataactaatagcatatcataaaaacgggtgcttcacatcaaagcacccgtaaaattttctaaattttttctaaaacgatcaaattcagaacctgttattaaagatatttcttcaaagtatccactttatccaacttctcccatggaagatccaggtcgttacgtccaaagtgtccgtaagctgctgtctgtttgtagatcggacgtctcagatcaagcatcttgataattccagccggacgaaggtcaaagttttctcgaacgatttccacaagcttatcatccgcaatctttcctgttccgaaagtatctaccatgacagatgtcggctgtgcaacaccgattgcataagaaagctggatctcgcattttttggcaattcctgctgctacgatattcttagcaacataacgtgctgcataagctgctgaacgatctacctttgtacagtcttttcctgagaaagctccaccgccgtgacgcgccattcccccataagtatctacgatgatcttacgtccggtaaggccgctgtccccatgtggtccaccgatcacaaaacgtccggtcggattgatgaagaattttgtattctcatctaccatatctgccggaaggatttcatcaaaaatgtattttttcacgtcttcatggatctgttcctgtgaaacatccggatcatgctgtgtagaaagtactactgcatcaaggcgggccggaactccattttcatcatattctactgttacctgtgtttttccatccggacgaagatatggaagtgttccgttctttcttacttctgtaagacgtcttgcaagtttgtgtgcaagagcaatcggataaggcatatattcttctgtctcatcagatgcatatccgaacatcattccctggtctcctgcaccgattgcttccaattcttcatctgacatcttgtgttcctttgcttcaagagctttatcaacacccatggcaatatcgcttgactgttcgtcaattgctgtcagaacgccacatgtgtcagcatcaaatccgtactttcctcttgtataaccaatttcgcgaacagtatcacgaacgattttctgaatatctacatatgcatttgtagtaatttctcccattaccataacaattcctgtagtcgcgcatgtctcgcaagctacacggctcattggatcctgctccataagtgcatccaggatcgcatcggaaatctggtcgcacatcttatccggatgtccttcagttactgattcagaagtaaataataatctctccatcttttttcctttcttttcttctttgtatctgcctctcttatctctggaataatgaaaatcgacaaacagaatttctcttctgtctatgcaaatttaaaggtcagccccaaaggactgacctgatatctcatcatcaatcctcttattgttcgattgctcgctcaggttggcaccttccggcttaccggggttgccgtggcttcgcaggtcctttgtacctccaccactctgaataagagaaagcgtatttaattgttaccgctacacatcataacactgtccatacctcccgtcaatatacattttgggaaatatgttctatcaaaacaggaattcctgtcttaacctacttttaacttgaatttctggatctcacgttctgtagaaactctctcgatcactgcaccgagacttctgagcttctcttcaaaacgttcgtatcccctctggatatatacgatgtcatctacgatcgtaatgccatctgcggccattcctgcaatcacaagtgctgctcctgcacgaagatccggtgcactgacccttgctcccgagaatttatctacgccttcgatagtcgctgcattgccttcaaccttgacatttgcacccattcttgcaagttctgaaagatatttgaaacgattctcgaaaatactttctgtaatcgtgcttgtccctttacaaagagcaagtgtaacaccgatctgcggctgcatatctgtcgggaatcccggatatggaagagtcttcacctgtgtattatgaagatctcctttggacacaacacgcactgcatcatcaaattcttctacttcacatccgatctcaacaagctttgcaatcgtagcttccagatgcttcggaatgacattcataacagtcacatcacctctggttgctgctgccgcaaacataaatgtgccggcttcgatctgatccggaatgatagaataatctgtcttatgaaggcgggatacaccgcggatcttgatcacatccgtacctgctccacgaatgttcgctcccatactgttcagaaagtttgccacatcgacaacatgaggctcttttgccacattctcaaggatcgtaagtccttctgccatcgatgctgccatcataacgttgatcgtagctcctacgcttaccacatcaaaataaatgtgctttccgatcagacgctctgcttctgcgataatcttgccatgctcgatatccacataagcaccaagcgcacgaaaacctttcagatgctggtcgattggacggcttccgatattgcatcctcccggaagagcgacttctgctcttttatacttaccaagaagtgctccaagcaagtaataagatgcacggatcttcttgatgtaatcatattctatatcaaaattttcaatgttgcttccattgattctgactgtgtgccggtcaatacggtcaacctcggcaccaattccactgattgcttccagcagaacgttgatatcgttgacatccggaagattatcgatagtaactgtctcatctgtcataatcgcagctgccagaattgccagtgctgcattctttgctccaccgatctcgacttcgccgaccagcggattgccacccttaataatatactgttccatttcgcacctcaattaacgatttctttccctctgaaatatatcctgttctatacttctgtcaaacactctattcatactctttattatttcatgaataaaaaacctcatactttttattctttccagatctctcaggatttgtatgaagctttttgtaataatcctctatatcacatatcagtatagcatatttctatattcattgcaaaattatttatcttgctttcttcattttcgtaaaacttttgtaataatttctttaaaaaatttattgattttccaaaacttccattacattttcaatggtttcttccagctccagtccatcctctgaaacagtaatatctgcatatttttcaaataatactactctttcgtcatatagatccttcagtgtctgcccgtcccgaagtgcaactccccttttctttgcattcttcagtctggaattgataacctcaaatgacgcatgcagataaacaatggttccgatctctttgtaatgcttcattgcttcttcacagtaaactacgcttcctcccggggaaatcaccgcatgttccgcttccacatcacgattgacctgattctcaatacttaagaatccattcagaccttcttctgcgataatctcccgcaaaagtctgttctcctgcttctgaatcaacagatctgtatcaataaactcgtatccaagccgctttgcgactaccactccgacggtactttttccaactgccggcattccgataaatataatattcttcatatgtaccctggctcactccttaccgaaactgtgtttcagatgctgtcatttttatatcggacgatattatagcacaagtcctgtgcatgaagcaactgttttttcctgttgccgcctgccttttcctcttctttccatcaattcctggtacatcagaatttctacgatctcccggatctgttccggagtataggtctctttttcccatttttcctgtttcatgacctgttcatacgccctgcgacacatcaggcacagctggagcttatccgggtactcatcatagatcatgcttccttcatattcttggcggtcgcattcttcctgtatatatggaaaaatcttttttgctgttgccggatacatactttgcaggtattcccggtcgcgcttctgaattttgtcttcgtcaaatgcgtatggaatcggatacatcatataataaggcaatctcaggtccatgtctggcacttccatttcttttttctatgctttagtgtatgcggtatgggggagtggggttcctgggaggtgggtgtggaagggggacgattttcgggcaatcctgtctccggggcggattcggaatgtaacagggagataacgttcctgcatatgccctggaaacaggattgcccgaaaatctgcgtgcttcaagacgggaggggcgccccggaactctactcgcgaagttgagtgttgttcaggacgggcgccaggcggacgtttgtcctgtggcttgggatattgtgtggggatttattttactggattttggttgtaaaaaggacatattctatattgaaataattaggtttatggtatactgaattataggtatatattttttcatgttttacgaaggaggatatatatatggatataattatcagacctgcggaaaccagtgattttgacagtgtagtacatatcctgaatcaggttcaggctttgcatgtgaactggcggcctgatatttacaaagaaagtaaggattttttctctttggatgcttttcaggatgctttaggtagagaaactttttatgttgctgcatatgaaatgtacaaaaaatgtggttttacagaaaagtcaatcaacatggaattattataagtagtgaggtgcaaagttatgaataatgaaattgtgaatgctatggaggaacttgaaaactggttggctgatccgtctgaactggggcggaaaccggcgaagattgagtatacggcttcttttgaggatgaggatgggatcaaatgtatgatctttaaattcaagaaatctttctttggaaaatggcttcttggaatcgtcagtgaatccggaaccttcagtgagatgaaggaatacaattctgccacagaaacagaagatgcaaaatcgttacttcatatattaaaagaatactggaaaaaaatagcagaaaaagaacagggatttatcgaaattccgattgaaaatctgatcgaatgggacgagccgaatggggaaggttgtatcgtttccgataagatcacaaaagaaggctacaaagtcggctacatgctccgcgaagagccaacagaagggaatccggacagtggctggagattcatggctggtaatgaagatgacgaatatatggacaatccggataatcatcatgtctttgcactcaacaccatctgcaattacgacagcgatattatcccttatcttcatgccaaaatcggatctgctttcatacgtgtagatgagtcccattttgaaaaatatcatgaatttaagcctatgttcatccaaaagcaataaataagtaaaaataaactctgttttttccacttcgccacaacatccccgtctgccaatgcacaggcgtgtggaaggtttgactttccggctgcgttttgtactacagccatcaagtcaatgagacgtaccagaaagccaaaccttccacacgccatcccattcgccacctacaacttaatcttagccagcgcatccgcaaatggattattcaccggctcatccttctgctgtcttaaatatttctgcacatccttcttgctgactcccgcaccttctttcttccgtctctcctggaacgatgtcagcttctccttatgtccgcagacacacacaaaaatctgtccatcccctcttcctttcagctgcatcttcttgtgacacacaggacatctcgcattcgttgtccgtgatactgtttcgcggtatccgcactctctgtcctgacaaaccagcatctcactgttctttcctttcactgcaagcattctcttaccacatcgcggacatttactatttgtcagattatcatgccggaacgttccagctcccgccttaatctcagaaaccacctgatccgtatatttatcaatatccttcataaaatccttccgcgaaagctttcccttcgcaatctgcgacaaacgcatttcccagtctgctgtaagttccggctgttttaactcttccggcacaagttccagaagctgcttcgctttcgatgtaagatagatatcttttccacgcttttccagcaaaaagcttttaaaaagtttttcaataatatccgctcttgtcgcaaccgttcccaatcctcctgtctcgccaagcgttttcgccatcgctttgtcatggctttccatataagccgtcgggttctccattgctgacaaaagtgttgcttcattaaaatgtgccggtggcttcgttttaccttctgtcaatgacaacacaagtcctttaatctcctgtcctttttccagttccggcagtgtctgtccttttaaaccctttccagactcatatgcttcttcctcttcttcatcctcagccgaatagatttcctcttcataaacagcccgccatccctgcgctttcacaacctttccagacgcaaggaaagtttcaccgccaaccttcaccgtaacctgtgtcttctcatactcaaatggcggataaagcacagcaagaaaacgccgcacaaccagatcataaatcttccgctcttcatttgtcatatgactcagatccacaaactgctccgttgggataatcgcatgatgatccgataccttcgcatcatttacaaaagcgagctttccgctcagatcctttttcttcgctgtcattgcaagcttacggtacggtcctgtaccacatgcctccagacggtccttgatcgtcggaacaatgtctttgctcagatatctggaatccgttctcggataggtcagcaccttatgattctcatacagtctctgcatgatattcagcgtctctttcgccgaatatccaaaccgctgattggcttctctctgcagctctgtcagatcatacaaaagcggtgcatacgtttttttcggtgtttttttaatctcttccactaccgctttctgttcatccagctttttcatcagtccggtcattttctctttatcgaatgagcgataactctttgacttctgatcctgccaggtcagcataatattttgtccttttgcagtcattccataataaccttccggaataaaactacggatcttttcttctctctttgcaatcattgcaagcgttggtgtctgcacacgtccacaggaaagctgcgcattatatttacaggtcagtgcccttgttgcattgattccaaccagccagtctgcctcggcacggcacattgcagcatcataaagcgcatcatactcatgcccgttcttcaactttgcaaaaccttctctgattgctttatctgttacagatgagatccacagcctcttgatcggctttttgcttcctgctttttccagaatcagccttgctaccagctctccttctcgtcctgcatccgtagcaatgataatttcattcacatccttgcggtgaatctgtgttttcaccgctgcgaactgttttccggtctgctttattacttcaagcttaaatggagccggcttcatcggaagcacatcaattttccactctttatattttttatcgtaatcttccggatctgccagggtaaccagatgaccaagtccccaggttacaatataacgctctccttcaattgctccatttatctttttcccacatttaagtacacgcgcaatatcacgcgcaacagaaggtttttctgcaattacaagtgccttcattctgtcttttctactcctttttattcttttctgctacttccatcattgtctttaatttatcctgtgcttcggtcatacaccggagtaacagtgggttaaatgtaccgcattcaccattttggatcatttccagtgctttttcatgcgaaaatgccttcttgtaaacccgttcactcaccagggcgtcatacacatccgccagcgatactacttgtgccgaaatcggaatttcttctccgacaagtccgtccggatatccctttccatcatatctttcataatgccagtggcaaatctcatatgcaagcttgagcagcttttcattccggtacatatccagattatccagcatttgtgcaccgattaaggtatgtgtcttcataatctcaaattcctctttggtaagctttcccggtttgttcagaattttctcgtcaattccaatctttccgatatcatgcaaagccgatgctgttgcaatcaatagtctatcttcccatgagagctgatattttcctgtctttttcaccagttgttccagcaaaagctgtgtgatcagattgatatggatcacatgcagaccactttctccgtttctgaactcaacaatctggctcaggataccgatcagcatccggttatttctctctttttcgtaaatctgcctggtcaccagacggatcagtctcctctgttttgcatatagcttgatcatgttcaggacgcgttgatatacgatttttgcgtcaaacgggcagctgatgtaatctgaaacgcccatctcatatgcccgtctgatatagctgtctgaatcttcactggaaatcatgattaccggaatatcttcaatccaatgattctggttcatcgcagcaaggacttcaaatccatccatttccggcatcacaatatcgagcagcaccagtgagatccctgttccataccgttccagttgttccagacattcttctccattagccgcctccaaaatccggtagtcctctttcaggatctctttcagaatctcgcggtttatttccgaatcatccacgataaggatctgctgtttcagtttttctgatgcagaattttcttcctttttctttccattttcatcccattctgtgacaaccatatttttataatttttagctatatacatctgtctgtcagcactggcaatagcatcttcaatattgccttcgcggaatacagctccgccgatgctgaccgaaagctgcattttctcatacttcggcacaaccgcatcgtggattttttcccggatcagttttagcttatcttcaaaaatatgcttcttaatcgaaggaaggatcagtaaaaattcatctccaccataccggatcagaatatccgtcttccggatatattttttgataatgttcgcagtcgttataagtgccgcatctcccgcactatgtccataagtatcgttatgaagcttaaaatcatccagatcaatcactgcaattccggcttcatcctccatgtttttgatcttttcttcaaaaaaacgccgattatatatcccagtcattacatccgtatatagcttttcattatatcctgacagtttactgatcagcttatcatacccctcctgatcaatctgaatactctcatcaagattctgaatcatttccataacatagggtctgccatcaatctcaacataacgcgagatcatttgaaatacctgcaaatccagaaattcaaattttatcttctgcgtctgttctttcagtgccagaagagagctacagttctcgcattccttgtcttttttccagaaactgtaacactgacacgtttcagataaatctcctgcatttatccgtttttcccgatccatcagcattttcccgtctaccagtctgacaacctgaaacacttccctcaaagattccatctttctttccgcttcctgcattgtcatttggtcctgtttgttcatccctttatcctctcaattttatccggccattcatactcttttttacgctatataatgatgttggggtcaaaaggtcaaaaatcctcttgcaagcaagcttgcatcagctttctgaccttttgcccctggtatcatcatataataaaattattataggcaaattcctccttattgtccagttttccttcattaaaaaaaccgaaaatccagcaaaggattctcggtttttaatgctttatgactgagctgctccaattcgggcaactgctcttttcagtgccgcctctgcacgacgcatatctgtgccttcctgcttcgcagcaattctgtcctcagcgcgcttcttcgccgcttcggcacgtgccacatcaatttcatccggccactgtgcatcttctgcaagcaccgttaccctctcctgcaggatttctacaaatcctccgagaattgccgctttcttaatctccccgtcattgtggattcgcatcacgcatggttcaagaatcgtcgtcagcggaatatgctttgcatagataccaagttctccttcagtacttacaaattcaaggaattcgcagtcaccctccagaaacttcttttccggcgaaataatgttaagtttaaatttatctgccataggacgtccctcctatttcacacgggcaagcacgtcatcgatattacctgcattcaggaaatatccctccggaatatcatcatgctttccttcgaggatctctttaaatccctgaattgtctcgccaattggaacataacgtccttccagacctgtaaactgtgtcgcaacgtggaatggctgggaaaggaatctctggatctttcttgctctggatacgaccagcttatcttcctcggaaagttcatccataccaagaattgcaatgatatcctgcagttctttgtatttctgaagaatttcctgtactccacgggctactttatagtgttcttctccgacaatgtgtggatccagaatacgtgaagtagattccagtggatctacagccgggtaaataccaagctctgtgatcgcacgggaaagtacggtcgttgcatccagatgggcaaatgttgttgccggagccgggtcagtaaggtcatcggctggcacatatactgcctgcacggatgtgatggatccgttcttcgtggatgtgatacgctcctgcagcgcacccatttctgtctgcagtgtcggctgataacctaccgctgaaggcatacgtccaagaagcgctgatacttcggaacctgcctgtgtaaaacggaaaatgttatcaatgaaaagaagtacatcctttccacctttatcacggaaatattctgcaagagtcagtcctgtaagtccgactctcatacgtgctccaggtggttcattcatctgaccgaataccatcgctgtctttttgataactccggattctgtcatctcatagtaaaggtcatttccttcacgggtacgttctcctacaccagtgaatacagaatagccgccatgctccgttgcaatattggtaatcagttcctggataagaacggtctttcctacacctgctccaccgaacagaccgatttttccacctttctgatatgggcacagaaggtcaacaaccttgatacctgtctccagcatctctgtctgtgttgcctgctcttcaaagcttggagcttttctgtgaatcggtgcgtattcaacatccttcggagcctctttttcatcaatcggctcacccagtacgttgaagatacgtccgagtgttgcttcgccaaccggaactgaaatcggtcccccggttgctacggcgtccatgcctcgcaccagtccgtctgtcggtcccatggcgatacatcttacgatatcatcacccagatgctgtgcaacttctaccacaagtttttctccgtccttgcgcgtaatctcaaccgcatcgttgatctccggcaagtatccttccgaaaacttaaggtcaagaacggcaccgataacctgggtaatcttccctatatttttatctgccattttctcctccttacatacagaaacctgtatttatccgatcgcctctgctccggcaatgatctcggtaagttcctgtgtgatcgcaccctgacgtgctctgttatatttcaattccaaatcatctatcatctcttccgcattgctggttgccgaatccatcgcctgcatacgtgcaccgttctcactggcaactgcttccacaaacgcgccatacagaatgctgctgatatatttcggaacaagaaggctgattgcctcttccgcttccggttcaaagttcatcggtgtaagctgcgcctttgcatcctcttctcccgcttcttcctgcacctctgccggaaggactttgatcatcgtcggaatgtgacttaccgtatttttgaaaaatgtgtagatcagatagatctcaccaatctcaccattttcaaaatctgtcagaagtctttttgtaatactcttcgcatcatcataggacggttcttcgatcatctctgaataatcagcgacaatatcatatcctttgtgtttcagaagttccagtccttttcctccaactgcatagatccggatattctccttcgtaaaggcttcattttcagtcaccatcttcactacattggagttatatccacctgccagtccacgattggatgttacaacaatgactgctttcttcttcgaatcatctgctttcagatatggatgattgatattccctgcctttgcaagcagagaggtcattgttgcatacatacagtcaaaatacggctttgattcttctgccagggttcttgctttctgcagctttacggtagagacaagtttcatggcttttgtaatctgctgcgtgctctgtacactggtacggcgacgcttgatatctctcatagatgccactttgtatcacctaccttgcctgaaattgttctttatattctccgattgcttttctgagagcttcttctacttcttctttcagcactttgtcattcttgatagattccggaatttccggatattttgtcttaatataatcaaaaagtccgctttcaaaagccagaatatcttctaccgcaatatcaagaagaagcttcttaactgctgcataaatgataataatttggtattctaccggcatcggctggtactgaggctgtttcaggatctctttgatccggactccctgtgccagacgttcggaagtctctgcatccagttccgatccgaactgtgcaaaggatgccagctcacggtactgtgcaagatcaatacggattgtaccagcgatcttcttcatcgccttgatctgtgccgatccacctacacgggatacagaaagtccggcattaacggccggtctgaaaccagagttgaacatctctgtttccagataaatctgtccgtctgtgatggaaataacgttggtaggaatgtatgctgatacgtcacctgcctgtgtctcgataatcggaagtgcagtaagtgaacctccgccaagttcatctgaaagacgggctgctctttcaagaagtcttgaatgcagatagaatacatctcccggataagcctcacgtccaggtggacgtttcagaagtaaggaaagggtacggtatgcagttgcatgtttggacaggtcatcataaacgatcagtacatcatctccgttctccatccattcttctcccatcgcacatcctgaatacggtgcgatgtactgcagtggtgcaagctcactggctgttgacacaactacagttgtataatccattgccccaaaggtctccagagtcttaacaagggaagctacggtcgaagctttctgaccgattgctacataaatacactttacgccctgccctttctggttgatgatcgtatcgatcgcgatcgctgtcttaccggtctgtctgtcaccgatgatcagctctctctgtccacgaccgatcggaaccatggagtcgatcgctttaatacctgtctgaagcggtgtatctactgacttacgggaaataacccccggtgccacacgctcgatctgacgatgcctggttgcctggattggtccttttccatcgattggctgtccaagtgcattaactacacggccaagcatacagtcgcctaccggaacctctacaactcgtccggttgtctttacagtatcaccttcattgatattcttatgatctcccagaagaacagcacctacgttgtcctcttccaggttcagaaccattccgtatacttctgaagggaactccaaaagttcaccctgcattgcattttcaaggccgtggacacgcgcaataccatctgccacctgaataaccgttccgacatccgatacgttcagctcagaggaatatctttcaatctgttctttgatcacagaacttatttcttctggtcttaaattcatggagcgaatccaccttctttctactaattctaactgctatacctgaattttcttcaggctctttgacagttcatacagctttgtcttaatacttgtatccacaactctgtcaccgatacggatcaccattccgccgatcagagaagcatctacctgataattcatctcaaaggattcatattttgtcgtctgaagaagccgctgcatgactgcttctttctgtgcctcgctcagttctactgctgtagcgatatatgcaatcccgattttcttttcttcttttacaagtccgataaaatattcaaatacagaatctatcttgctgtagcgccctttttcgatcatcagcttcatcagctctacaatctcatttgaaacacgtccgcggaaaatcgtctcgatcatctgctctttgtcttcacgcataactctcggatttccgagaatcttctgaagctctgcattttcttcgaggatcactccgatactctgtacttcctcgaatatctcatccatttttccgcagtcacgggcagcttcaaacagggcgtcaccatatacctttgatactagcttagccatgtctgttctcccatttcttttaatgtctcttcgatcagttcatcttgtacactggtatcgatcgaagctgctactactttacctgccattgctgatgcaatggagatcatctcctgcttcatatcatcaagcgcacgcttccgttccagttcgatctcattattggcacgtgtgatgatccttgctgcttcttcttttgcttctgcaacaatttcattttcggtcttcatcgcttttttccgtgcttcactgagaatagcctgcgcctctttatcgatttcttttaatttctgttcgtattcttctttgtaaacggctgcctctttccggtcattctttgctgactcctgttcatcagcaactctctgctttctgtcctccagaagttttcttaccggtttgaaaagcagatatgacagaaacgtgaacatgacaagcatactgagtgccatgacacaggcatcaaaaagaagctgcgcatccagattaaacaaacgttccaaggcgttgcctcctttctcttattttacaggcaaaaccttttttacagctttccaagaagcgggtttgcgaacaagagaataagtgcaataaccaaactgtacagacctgttgtctctgctactgcctgtcctaaaagcattgtagacgtgatgtctgatcttgctcccgggttacgtcctactgcagatgcaccatgacctgccgcaataccctgtcctacaccaggaccaatacctgcgatcatcgcaagtcctgcgccgattgctgaacacgctaaaattaaagcttcatttgaaatattacccataataattttcctccttaatcactgcaaacctgatactgtctgaacttagatcccagtttgctttttactccgctgacggcatcttgtcattgatatataccatcgtcagcatgcaaaatacatatgcctgaattgctcccgagaacacatcgaaatagatgtgtagaaatcccggccatgcccatgcgatcttatacagaagaccatagataagtcccatgattacagtaccggacagcacatttccaaacagacgaagtgagatggaaaatggtgctgcgatctccccgatcagattgattgggaacaagaacggcaatggtttgaacaggcctgtaaatgcctcaattttgttgtatttgatgttattgaactgaatcagcacaaatgtgataagtccaagtggaagtgttacaccataatctgcagttggtggccgaagccccaaaagtcccgaaaggtttgccacaatcaaaaacaaaaacaaagacccgatataattccggaacgccagtccgtttttccccatgcttccttttaccatattgtcaagcatctcaacgataagctcggcaatattctgcagggttccgggtttgccttcggcatcgctcagcttagctcggacaaccaacgcaaaaatcagcagtaataacgctacgatcaatatgctgacatgtgtagtggtgagccataactcctgcccaaataactggaatttaacgagaccgtgaatttgaaaatccggctccttagctgccagcattcctaagctgttccccacgcgctctacctcctttacttagattttttgaatttagcgaaaagcttatgcataattggctgcaaatatgccgcaagctttaaactcataattcctgcaaacagtgtaagtacattcgcaatccgaagccagctgacggctataaatactacaactacaaccagatatcttatcgcgtaagatttctgcatgtatctctgtgcttcctgttctccataaagtaccgcctcatccaacgagtttttcatatggattaccatgaaaacacctgcagccaccccgatccaaagccctgctgtcattctcagatgatcccctgggataatcagacatacaatctgtgcgattattccatacagaagcatagtgatgatcatatccttcagtacggtattgtctgttttactcatgttgtttcattcctccctgctcaatttttgtttttgtcttccggatcttcattcgcatgtctcgcaagtacccatgcattgcgcagacctgccaatacacccactatcaccaaagggataaaaactggaaaagaaaccttcttttccagccatgtaccaaaaaaagtgcatagcaaaatgggaaccagtatactgatgcctaactgactgatgagtgcaaaggttttatatacgctttgtttatatttcatgatacttatctccattctctatatcactctccgtttattatatccttttttatgaaatatgtccactgatttacacacgattgtattttttcttatacaatttccaaatattgtcatcacttttaccaataaatgccattaaatgcgttgattatttaaaatattttatatagtcatttttttcacaatagtaaaagtgctgcaaagcgtttttagccttgcagcacttttttattcatcccattccagtctgtgaagatgtccttctgtattcattccggcaaacccattctgccggagcgcttcatataacacgatcgcaaccgaatttccaagattcagtgaacggatatctccgatcatcggaatccggatgctgtcttccttgtggtgacagaggatttcttccggaatccctgcgctttcttttccgaacatgatataacagtccggttcatatttaacatccgtataaagattcggtgattttgtagttgccatataaatcttcgctcccggatttttttccataaaatcccggtaatcaatataagtcgtcacatccagatgttcccagtaatccatccctgcccgcttcaggttcttttcatttaaccggaaaccaagtggctcgatcagatgaagtctggtattcgtcgccacacaggtccttccgatatttccggtatttgccgggatttccggttcaaaaagtacaatattaagcatttacattctccttcatttcgtaaattcgtgccagttcgtccggtgccggtctgtcgagaaatcttttttctcccccaccccagatgatcctctcgtttccttctgttgtgtgtccgatgatctctgccggaataccttcccttttcagtctttcctttagttcttcacccttcggtgtcaccataagaaccgctcctgtactggtaagctggtaaggattcagatgaaatacttcacagacttcaatcgtttcctgacgtaccgtcattttcttcatctctaccgaaagaccaattcctgcaccttctgccatatcccaaagtgctgcaagaatccctccttctccgatcggatgcattgctgacaccccgttccggccggcaatctccattgccctgtcactgaaaatttcatctctcatatcttccaacttatttaagaatcccggcgcaaaccgctctgccagagccgccccttcttcccgtatgatccgtaaggttccttccataccaatccatttaaccaggacaatctcttcgcctgcttttgccgatctgcttgcaagcagctgttctttttttgcctcaccgtgtgctgttacatgaacaatactcgtctggatcccatttacactttgcgcatctgcaaagaaaaccctgagacctttttctttacatatctccgaaatctccaccatcatcgctttcaatctggactcataggcaaacgtcgggagcatgatccggacactgattccatatgcccgcgctcctctggaagccagctgatccactgcctgcgctatggcaaatactccaagatctttttcatttccggctaatgaaacatccgttgcgattgtgatccgctcttcactttcatctgctatataacaggtttcctcctgtgacggtcttaaaaaatctataccttctatattattctgtatctgttttaaaaccgaacgccgatagacggtctgtgacactcttcctgctttcatacttttatcctctttctgttctgccattctttccaacagccacctgctttttattacttaagtgcagatgccttgctgatcgccgcattaatcttctcctgatcctgggtttcaattgcttcctccaccagcttagttgcctctgcattatctgattttgtcccgactttcacggtaacatcagaagtctgataggtgctgttattgattacttcccggctgacctcttctccgttttcataggtaattttccagagccgtgccgtgcttccatccattccggctccctctgtttcctgtgagccgaccgcactttccgtatcttctacatactttttcgtatactctgttgtctccagagtctcactttcaaattccacggaatgtcctgcagctctggtatcttttccgtaaatataaaaaccaagctggttattgccatcaatatatccttcgatcaggatcggtgtatcgtaattattgacaaatttaaaatcactgattccttccgctatcattgcatcccttgatggttctacatagctgacactcatggaatgcggtgcacgccgggtgacctccagttccgcataaagaaccgcattataaagcgtcgtagatacctgacacaggccacctccgatactctctacaatctgtccgttctcataggcacttcctgccacatagccattctcttctgtgtaaggaagtgtggcctgttccactgaaaattcttctcccggcataacaacagttccgttgatcagctccgttgcacgcctgatgttctgcacgcggtccccccatccggcgtttgtcgtataagagccaagctcatcctgcagggattccagatctgcctttttgatcgtcggcttttccatatccagctttaactcgacttctgcgtcctcgtaattccattttttgttcatgaaattcttaatcttcttcacggatttatctacatcaaccgtataaccttctgcttcatccgtcagatcgaatccgcttccgttataggatgccgatgcattgaccgctttctgttccagcggaaccgcacgttcctggatcagctctctgagttttgcttcatcaactttaaagctttcatctatgacatatttcttcttatctaaattatgtatcttctgatagcggctccagatgcttccattttttccgtatccgaccgccttttctgcaagctcatcaatattttctacttccgttcccatttcctcgattgacacatctgcgccctgatcttttaccttcagtacaagttgcttgttccgataatctccaagtgtattgtctactgctttcactgcttcttccttggtcattccggatacatctgtcttccctataaaaacatttttgcagatatactcctcatccaccttgctcacataccgccataatgtgaactgaatcacggagaaaataatcacgatggctgcaataaccgtaatccccacatgcagatttctctgccggatacgtttttgtgccttttcacttaactctctctttttctttcgtgccgccatcaaaaaaatcctcctgattttatatgatatatggaataattgatgttgctaccattgcaacaataacaacaagaataatcactgccgctatcttccgtgtctgttttggattaaacactttttttcacctcaaatcacacatttgttttcattctatactctttcatttcttttttcaagatatccattactactgtcagatgttactgtttgcataattcccagatttcttctgtaacacaaaatacctttgcctgatgatccagtgggttccggttctggtagtcaaacagaagcacacattcttcctctttcatatcccccagaacatcataagaaaacctctcgatgtgcgtcatttttctaagctgccgcttctccatattttcataattttccagataacgcctctcttcatcctcacggtcatagaacaagcggaactcttctttggaaatccgctcatcgcctgcaaataacggacggctctttgcattctccctcagataaaagtccagtgtcagaagctgcttatacgcctcacatctttctgcatcataaaatcttgcaaaatcatacaggatctcatatcttgccgtgcgtgcatgacttaaagtatccagcccattttcttcataatactctgccagcttttcaaaaagcgtaaatggtcttttaaagtgtcggatcagataaggaagcgtgtaacagaactgcctgctgttatagtaggtctccaccatttcctcgatccctttcaggcgcagggtatcctcatatggaagccactttgtatacaaaacttcatacggtggcattcctttataaaccagtccgtaatcgtctttcttctcttccatataagaacccttcagtactttcagaaaaccaagctgcagctgctccggttccagtgcataaacatcatcaaaggattttccaaagctttcataatcttcatacggcaatcctgcgatcagatccaggtgctgatgtacattaccataagaattgattctccttaccacttctgcaacctgttcaaatttcattgtccggtgaatctcacgtatcgtatccaggttggtagactgcacaccgatttccagctggatcagccctggccgcatggtttttatcaattccatttcttcttcattcaaaaggtctgccgcaacctcaaaatggaaattggtaatgccgttatcatgctctttgatataacgccagactgtcatggcgtgatcatgtttgcagttaaatgtacggtctacaaatttaacctgaggtactttatgatcgataaaaaattgcagttctttttttaccagttccagatcacggaaccgcagacacttatctatagaagaaagacaataactgcatgaaaatggacatccacggcttgtctcataataaataatcttatgttcaaaaagctccatgttctcatatacaaacggaaccttactcagatccatggtcttgcgccattcattttccacaatctgcccggtctgttcccggtatacgattcctttcatattctgaagtccgtccactgtcttgtcctgataaaagtgtaaaagatcgcagaaagtctgctccccttctcctttcatgacgccatccacttctggcagacgctccagcacctttactccatcataagatacctctggtccgcctatccagatgatgatctgcggcatcactttcttgatctccctgcagatctcttcaacataagtaagattccagatatagcaggacagacagagcatgtccggcttccttttgtagatatcccgcagaatctcatcgagctgctgattgatcgtatattctccaatactgatctcatctgatgtatcaccatacttttccgcatatgctttcagacagtagactgccagattggaatgtatatatttcgcattgactgcacctaaaagtactttcatatcgtttcctttccgtttccaaaaagttttatctttagtatcatactccattttcagattgacgtaaaccaaaatgataaaataaaatctcctcagatacattgacatttttacaaaaacacggtaaaataatgttctgtgcagccggggtgctagcggtaccctgtacctacaatccgctatagtgggggtgatgctgtgccgagggctttacttgtcaaagctgcctctggtttgtggcgttgagatttgggtcttacgcggcgggactctgtgaaccgtgtcaggtcgggaacgaagcagcactaagcagaacctctcgggtgccgtaaggtagcctgggttgagtttacagccagagtaacgtttggtaggctttagttcgacgcacagcgcacagaaaaaagaaattacaaaagctacggattttgcttccgtagcttttttcatgcaaaaaagcctgcctttgacaggttcttcgattaaggattttcttccggcatatttgctgattcctgttctttctttttcatcttctgcttcttgcgcagttccttgaaaaagctcttcatcatctgtgagcattcttcttccagaactcctgtcgtaagctctgcctgatgattaaacgcttccacctgtagaagattcaggatggaaccggcgcatccggctttcggattcatacatccaacaaccactcgtggaatccttgcctgtacaatggctccggaacacatctgacatggttccagcgttacatataaggtgcattcttccagccgccagtcacccattaccttacttgcctttttgattgcagaaatttctgcatgtgcaaggggattcttatccgttgtccgcctgttgtatcctcgtccgataattttcccctgatatacgatcacacaaccaatcggtacttcctcaattttccatgcttttttcgcctgacggatcgcttccttcatgtatttttcgtcttcggtcaatatcttccgcatcttccttctcctttacttcttttcgaatcactgcccctaccggtctgcaccagtaaccgaaatgttcctcatcttcaatctcatattcttccagatccagttcgccatcagatggcttcatgaactgactgaatccaaatgctcctgccgcccgctgctcgcccgaaaaataaagtcccggaaccccaatccagcatttcccttctttttcaaatgataccagatgatggtaattataatatccatggagcagaaaatgattattcgcaagcttccattcctttcgcggaagtccggcaagctcctgacgggtgatcttatagatgatatcctttgtggtttttggtggtaaatctgaatttgcgttctgagagtttctttcttccggcacatttgggttgcttttcgatttcctaactgcatctgtgtttttagattgttctgaggtctcctgttcttctatattctcatattttctctggcttgttttctcctcaagtattttctcatttcctggcttctcgtatttttcattgcttagcacgtctccgccatttgcaatttttttatttttccccgatttgtttagcttccattcttcttccgtaatcatcctgctaacatctaccggtctcgcctcatcccagactgctccataatatcctgcatccgctccgtttccagcccgaaggatcattccaccaatcctgccaaactgtccatctcctcccacatcgtctgtcgtataactcagcttgtagccaaatgccgcctgtgcgcctctgatctctcccatccggattccaatacacttgccatcctcttcataaaagagatatatttccagtgtacgtcctcctgccaccggaaatcctctcccataaatctggatttccgctgtatctgtctgttcaagaaccttcacaaaacctgtatttcttgtcctttttccattctgatattcatataaataccggataaagcttttcataatctagcacctgcaccttccttctaactgcctgttctaaactattctgactttccggtaaaaattaccatttttaaaaaatcagagcggaatcttccgctctgacaaataactcattgattaatccagataaatcggtggctcgtagtcttttcccatcgtagctttctttcgctcttccaccccaaggaacgcccactctgtcatgtctgtccacttgtgatcttttcggtcatatacctgtacataaccgattctgtgtggatgcatacgcacactgtttgtccgatactcatgtccggtatatgggttcacatctccatttaccagatcttcatcaatatcctcccgacgcttgatcggctggaaatcctgcggccatccggaagatttcttttcctttttcggagtaatcagctttgtaagttttgaaaatggtgaatttttctcctcatgaacatcttcagtttccgcctcttctactacaggattttcctctttctgacaggtttccggctgattctcttcataagccggctgttcctggtacgcttcttcctgcggttctgcctcttcctggtaagcagcttcagaagtttcctccggaatctcctcagccccggcttcttcaaccacttccgcttctatttcctgttcgggctcctgtaattcttcttcaatctgttctgcgtcttctgcagatacttccacatcatcttctgccggttctgtgtacggctctgtttcttcttcagtcagaatatcttcttccaaagtatctgaatccgcaatgctttccgtctccttggcagcatgttcttctgcatcaagatccagttccatctgtacagcttctttctccggttctgctgttgtctcttcaagtatatctacaatctctccaactgtaatatcacgttctacattcttttttgcttcttctcttgctgcctttctttcttttttcgcggtaagcttctcaagttctcttcccgtcggcatctcttcttcatccaaagcctccttttccgaatccgcattacccagaatgctgagctggaacgggcatccaagaatatctgcgatcatacgcatatcctgctcctgaaaattatctctgccaagccgctgtgtcagattctgacgggacatctttttcccggttcttgcttcgatttcttctgcaagctctttaatcgtcatatcttttctgcttaaaacaatttttacctgctctccgaatgtgagactaatcatttatttttcctccttttctccccgtataaatatatcttctttttaaatacagacttattgctttgttaacttaaaactttcttgataaaggaatctttttcacttatcttttattctagcaaatgacattttatccgtcaacacctaataaatgcacgaattttttgtatttttttaaaaataatttgacaaatcaaaatcagtcgctataataaagcgtatcaagaacgacggcgttccctattatccggggaacgccttttttgttctttttttaaatcgagaaggagggactcagttatgaaaaaactagaaatcattatccagccggaaaaactggaagccctgaaagcaatcctggatgcttccaatgtcagcggtattatgatcagtaacattatgggatatggtaatcagaaaggacacaaacaattttatcgcggtgctgaatacagcgtaaatcttcttcctaagatcaaagtagaaactgttgttgaaccggaagttgcagaacctctgattcggaaaattgtcgaagagatcaaaaccggtgcgtacggcgatggtaaaatttttgtttacgaagtacaggatgctgtaagaatccgtaccggtgaacgtggctctgctgctctttagctaaaaatatatgtgaattagaatagtgttgaatatcgttatcaaagaggataactacaaatgaactgcctgtagatcattcattgtagctatcctttttatttgaaatggaggatgttaaatatgggattatctgatttaattgcgggcggaatggatgcaaccgccgccactgaactactgcttaatgttatctggacaattgtcggtgcaactcttgtttactttatgcaggctggatttgcaatgtgtgaagccggatttaccagagcaaaaaatactggaaatatactgatgaaaaatatgatggactttgtacttggaagtttgttctttttcatcttcggatttgcgatcatgcacggaaccgactggaatggtatcatcggtataaaagggttcttcaatcctacaacacttgccgatgccgacggacttttcaacggactgccaatcggagtcttccttattttccatacagtattctgcgccacatccgctactatcgtatccggttctatggcagaacgtacaaaattccttgcttacttattgtatagtgcagcaatcagtatttttatttacccggtaaccggccactggatctggggcggtggatggctcgctcagatgggattccacgattttgcaggttccacagcagtccatatggtcggcggtatctgtgcacttgttggtgccaaaatcctcggacctcgtattggaaaatatgataaagaaggaaatgcccgtgcgattcccggacacaacctttccattgcagctcttggcgtatttattctctggttctgctggttcggtttcaactgcggctctaccacagcagcttccacaaacctcggtgatatcgcaatgacaaccaatcttgccgctgctgccgcaacacttgcaacccttgttgtaacctggatccgctatggaaaaccagatgtatccatgacattcaacggttccctcgccggactcgtagcaatcaccgccggatgcgacaccgtcagcaactactctgcaatcatcatcggactgatcgctggtatcctcgtcgtattctctgtagaattcttcgacaaagtagccaagattgatgacccggtaggtgcgatcagtgtccacggcgtatgcggtttcacaggcagtatcctcgtcggagtcttctccccggaatacaccctcaaaacccaggtgatcggtgtcctttcaaccgtagcctacgtcctcgtaatggcaatcatcgtattcaccatcatcgataaaaccgtaggcctccgcgtcaccaaaggagaagaactcgacggtctcgatatccacgaacacggctgctcagcatatgcagactttaacttccgtttatagccgggcgaagtaaaataaaaagatacagcctctgggatgcttgcatttcagaggctgtatctttttattttaatgagcggctacgcgactgaggaaagtcatcagactttccgaggttcgcccggcggacgtcttgtactacctttatcattctacatcccctgcaatccttccatttcagaggctgtatctttttattttaatgagcggctacgcgactgaggaaagtcatcagactttccgaggttcgcccggcggacgtcttgtactacctttatcattctacatcccctgcaatccttccatttcagaggctgtatctttttattttaatgagcggctacgcgactgaggaaagtcatcagactttccgaggttcgcccggcggacgtcttgtactacctttatcattctaccacttcttattcttcagcacgatcgccgatttcttacccatcatcagtgaaatatttccctctttcacgatatactcttcgaattctccaatatacccatcttcataagaatacatcactcgcgccatattatgtccttcggcaacttctgcctgccataccggaacccttacttccttcagatgatcggaattattgataataaccacgatctgctcattcccccagaatcttccataggccagaagatccggttctgctttcagcatcttgattgatccctttctgagagccagagactttctgtggatttggatcatctcacggtagaaattgatcagatcccggttttctcttccccacggataagttctccggttatccggatccgtgaaaccacaaagtcctgcttcgtctccataataaagggtcggtgctcccggccaggtcatctgcatgatgatcgcttcccgcataactgcaaggcttaccccttcttctgccgcacgcgacccaagctgtcccacacggccaaccttgtggttggtacgcgtcaggaaacgggaatggtcatggtttgacaactggttcatcgccgtctgaagtgacggtgtcatcatatttgccatatgatgcttcatcgcattcataaaatggtctgcatttccgagaagatcgtcgcgatattcatcactgtgtttctccatcccggtcagaaaccaggtgaccggctccataaatgcatcgtaattcataacgctgtcccattcatcgccctgcagccagtcactcggatctccatagtgctcggcaaggatcagtgcatgtggatttgcttcttttactgccttacgaaatttcttccaaaattcatgattgtactcattgcttcttccaaggtctgccgcaacatccagtctccagccgtctacattatacggcggtgaaacccatttctttgcgataccaagaacatactcttccagctcttttgaatcttcataattcagctttggcagcgtatcgtgtccccaccagccgtcatagcttccattgcccggccattcattctccccggtacggtggaatagaaaataattccggtacggactcttcggtgacacaaaagcacctacttcgtaaccatcggcgctctcgtagatcagctctctgtccagccatttattgaaagaaccacaatggttgaagacgccgtcaatgatgattcgcattcccctcttatggagttcttctaccagcttgatgaacagccggttacttgcttccagattctcttttctggtagttcttgtccggtaacggtccgcatggatattgttattttctcccggatctagaagccttccttcatcgacttcaattttaccgacatgcggatcaatataatcgtaatcctgtgtgtcatatttatgattagatggtgatacaaatagtggattacaatagacaacttctactccaagtccatgcaggtaatccagtttatcaatgatcccctggatatctcctccgtaaaattcccgtacatccatcggctgcggatcccggtaccagtcatctacatgctgaacctgttctccaatataaaagtactctcccgtctgtacatcattatccgggtcgccgttacagaagcggtctgtataaatctgatacatgaccgctccttttgcccaatccggtgccgtaaagcccggcacgattttaaaatcataataatccacaagtttgctctctgctccccatttgttatagtagcagatctcatttcctgatctgatcttaaaatgataccggaatggtttatcttctaatttgtatttcacttcataaaagtcaaatgccttatttgagattactttgttcattggaatgcatagttcgcggttttccagatagacttcatctacgtcgtgagctgctgtacggaaccacaactgaagttcatctcctgcctccggttccggcggactcacatacgcctctgttccatcacaaaacaatgcttcttttttcataatctagcctctattcttcaaataatgcttcaaattcttctcttgtaatcttctctttttcaagaagcagatctgcacatttataaagaacagcttcatgctctttaataatggtctttgcacggtcataacattcatcaatgatccgcttcacttcactgtcgatcgttgtagcaacctgttcaccataacctctggaggtatgaccaaaatctcttccgataaatacttcatcattatcatctccatagcttacaagaccaagtgcttccgacataccgaacttcgttaccatggatttggcgtatgctgttgcctgcttgatatcctgggatgccccggttgtaatatcatcaaagatcagctcttctgccacacgtccacctagtgatacggtaatatcctgcaacatctttcctttggtattgaacatctcatccttttcaggaagcggcatcgtatatccggctgcccctacaccggtaggaatgatcgacacgctgtacaccggtcctacatccggaagtacatggaataagatggcatgtcctgcttcatggaatgcagtgatcttcttctctttatcagaaattacacgactcttcttctctgcaccgattccgacttttacaaatgctctgcggatatcctcctgttgcagatacactcttccatcctttgctgcaaggatcgcagcctcattcagaagattttccagatcagctccggtaaatcctgccgttgttctcgcaacctgttccagatccacatcatccccgagcggtttgcccttggcatgaacctgaaggatttccaggcgtccctttacatccggtctgccgaccatgactttacggtcaaaacgtcccggtcttaagatcgccggatcaagaatatcgacacggttggttgctgcaagtacgatgattccttcattcgcgccaaaaccatccatctctacgaggagttggttcagcgtctgctctctctcatcatgtccgccgcccataccggttccacgacgtcttgccacggcatcgatctcatcgataaaaataatacaaggtgcatttttcttggcatcctcgaaaagatctcttacacgggatgctccgacaccgacaaacatctccacaaaatcagagcctgaaatggtaaagaacgggacacctgcttctcccgcaattgctcttgcaagaagtgtcttacctgttcccggaggtccttcaagaaggacacctttcgggattctggctcctacctgcgtatacttcccggggctcttgaggaaatccacgatctctgcaagctcttccttttcttcctgcagtccggcaacctgcgcaaacgtcacatggttttcttcctgcgtgctcatctttgccctgctctttccgaagttcatcgcttttgcattcgatccgccctgacgattcatcatcatcacaacaaataccatgatacctgccatcaatatgatcggaaccagtgttgttgacatccagctgtcctgcgggacattgtccacactgtaggaaatgtcataagattcaagcagatcctctgcactgttgacatcggatacatgaagctgttcgatgtcatcattcttcagccggatcttcagtgtcccggtcggtgcgactttgttctgcttgacctctacactttctaccttctcttttttcagatctttctgaaaatcctgatacgtgtatgctgtctgctgcacacccgactggctcataaaccagtacacacctgccagcaccagaacacagagcagaatcgaaagaccactgattcctcttgtcttattattattcaaaacctgctccttccacctgttacatctctacacttccgatgtacggtaagtttctatatttttgtgcataatccagaccgaatcctaccacaaattcatccggaatattaaatccgacataatctacatgtacgtcgcgcacacgacgatccggtttgtcaagaagtgtacaaagcttcatgctcttcggtcctctcttccgaaggatgtcaagcagataataaagagtacgtcctgaatctacgatatcctcaacaacaattacgtcttttccttccagagactcatccagatcttttgcaatcttaacgattccactggactgggttccgtcaccatagctgctgacactcataaagtccattgttaccggcactgtaatcctttttgccagttcacacataaagaacactccaccctttaaaacacagatcagatgaacctgctttcccgcatattcttcactgattttttttccaagttcttcaattctggcatttacttcttcttccggaattaacattttcactttctcggccatttaaagtacctccatttatcgtaatttctaatattttcgttgtctgctctgtcacctggtatgccttgctctgccggcagcccacaatccataaaatctcgcttccctctgcgatcagaggaattccggcgcgttctgccactggtatttttttattgataaaataggatttcagcttctgccttcctccgcttccatcaattacaataaaatcgccagcccttctggtgcgtacagcgacactctgttttattataccataatcaaaccatttcgtgtacgtttttttcgggatctggcatctgcattcttctttttcaaaaatacggtaggaaatttcccatttcccgtaagatatctttcccgaaacctgcttcagatccagatttttctcttcttctgccaattccgtgtccttctttttccgcttcagttcaatcccttcataggttctgcatgcacagaccgcataaggaagatccagtctttttccaacctgcttttcaaacagtccctccagcttttctacatgaacctgctccagatctttttcatgttctgccaccaatgccaatgctttccgtagaatcattttccggatcagccgttcctgtcggtgatatgcatctgcatggatgcagattttttctccattttggtcagtacagatctgatatgcactttccgtctgccgttccatataatcccagatctccctaagctgatccatagaccgattcatatgctccacggttttttcattgatattttctttaaaatacggaatcacatggttacggatgcggtttcgcatatatgcatcttccatatttgtcgcatcaatgcagtaaggcatctcccgtcctttcagataatcctcgatctcttttctccccacgcaaagaagcggccgtatatacatcccatttaccggatatataccgccgagtccccgaagtccgctgccgcgggccagatgcaggaaaaatgtctctgcattgtcatcctgatgatgtgccagtgcgatccttgttcctccccattcttccgctgcctgctcaaatatttcccttcgtgcagtccttcccgcctcttcttctgacatcctgtattccactgccattttcggaatatccaccgaaacactcctgcatgggatttcttttttctcacacagtgtctttacaaattcttcatcagcttttgcctcttccccacggatcccgtgattcacgtgtaccgcaaggatctcaaatccgatcttttttcgcagctcttccagtatcagaaaaaggcatacagaatctgcccctccggaaagaccaacgacaactttatctcctttttcaagcatcttccactgcctgatatagttctctactttttctaacatggtaaattcctctcgtcttttatctactgtaacacatcttccagattcccgccacaaggactgtcatatcatctcctgcttttccggccgccagctccagcaccttatccagaatataattcgccagttcctccggattctccagcggacttcccccaatcatcagatccagtaaatgctcctgctctcctgccggaagcgcatccaggatcccgtccgataccatgaccaccacatctccggattccaactgtctggtttccttttcactttgctgtctctggattacccccagcggaagactttccgaacggatatgctccaccccgtctttagtccgcagaaatgtcactgccgctcctgcttttacaaactcacattttccattatagagatcaaaaatgctcatatcaaccgtagaaaagcgaacctcttcccgtcccataacaagagccgtattgatcatggaaagtgcagtttccacaggaaatcctgctccaagaagctcttccagcatttctaccagcatcccgctttcctgtagtgctctctcaccagatcccattccgtctgacaaaattgccgcctcttttccacccggaagtatcttcataagaaaactgtcaccagatatcttttgtccgttttttcccatttttgctacaccctgcagcacataatatcccggtccttccacacatacaatagtttcatactcctgtcccagaacctgcctctcgttctgagccgggcacatccttctcttagtacatactgataaaagctctgccgcttttctggttgggatacagtttcccttctcactttttaccgttacatgaatttcatatctgccatgctcatccacaaaaaaaacggaactcagcatccggatccctgcctttttgaaatgctgcgcaaccttttttgcaagcggcggatccgcaaaaatactcgcatccagatctctcgtcacatggcagagcatgtccgcaaaagaatccagctgtgccgcacatccctcacggctctgtaccatcttattattccacaccaaaatcctttttgcctcctggaacgtttccagtgattctcgtaaaaaccgtggtgcctgaatacactctctctgaagatgctgtttcatctctttattcagttctgcaccatatccttcaatcgtacacaaaagatcataaaaaagctgccagtgttctgccttctttctctccaggcactctgatttcctgctgcatcctctgcacaccttctccgtaatccgatcatacatttctgtcatttcttcgggtgtaaaacactgctttttcggctccattttcagaaacctgtctgccagatgccgaagcgacactgccattttatctgcctgcgttacatatggacttgtgatcacttgctcctctctgtatttaacctccatttgccaccaccctctaaatttctatgaatgaaaaaagcttcgggatattttcttcccaaagcttttcttacgttactgctgtgcgcggaacagaatctcattctcctttacaagtcccagcttctctctggcgacttcctcgatgtattcatctgttcctacatattttttcagtttattaatttcttctgagcgttctttttccgcatcgatctgtgtctgcagttcttcttcctgcaccttatatgcatcattgctctttttgagcgccatcccatgtacaataaccatgccgcataataatataataactgcggtaatcgcaacaatacttcttttgtgcttctgaagcccgctccccggacgctttttccggttcttctttaagcttcccatctaatctattcacctttcgctatcagttgatcttgtatagcttcttactaccaaacccatttagtcttctacagtgtaccgtttttaatcagatttatcaactctttttactcttttttcacaaattcgtgtagaaatctttttgtaagctcttacaaagacagctgaaagcagcgccatcccgattgatccgagcgcaatccccagtccgatataccaccgcagaacaccatcactcgtatgatagatctgcacaaaagtataaacggaaattcctgcccagtaacaggcatcctccagattgatcagccacagtctgtgagcaaccagtctgcgcaaaaccctgatccacagatagactgccacaatcaggacaccggtcaggattgcatagcagaaaaccctgatctcagttccgataccagacattttttctcctcctaccgaaacagttttgacaacagattttctccggcttttgctcccgaatggatatccgaataagaaatattgtcaatattgcctgccaggtcgacctcccctttttcaagattcagccggtttacatgcatgtccgtaccttttaccatcagcattccctgctctgtctcaagcaggatttcatttaaatcaaaagaaagaacgtccagcactcccgttactgtacctgtcttccggttgttgataaccagcctgtgattctgaggttttaccagctgtctctcttccatacaaatcccaacctttcctatactgtctttctagttattgtatgaataatatctggtaaatatgcctcggatccgctgccggaacaatctcaaaccacatcttttcagatgttccggaactttatagataacggaataaatctgctgcctcttcttttttagtcgtatctcgcagatccaggacctctgcctttacagtcttggttccaaactggatctcaatgatatcacctttttttactttcgtggaagccttcgccaccgccccattgatcaggacccttcctgcatcacaggcttcatttgcaacggtacgccgtttgatcaggcgggacacctttaaaaatttatcaagtctcattttgatttttccttcccgtaatatgaataaagcgcagcccttttcagactgcgccatttttcaaaaatgttctacaaattatgcattaacagcatcttttaaagcttttcctgctttgaatttcggagccttgcaagcttcgatcttcatagtttttccagtctgtggatttcttccttctcttgcagctctttcgcttacttcgaaagttccgaatcctactaactgaactttttcaccttttttcatttcttctgtaacaacatcaacaaatgcttttaatactttttctgcatctttctttgaaatatctgcctgttctgcaactgcagctactaattctgtcttattcatgacttacgtcctcctgtaaaatatactcccggaacaccccggcattttgtctttttgctaggtttattctgcgtatccatgcgttctgacacgccccttaccctacatatgttatataggtttttaccttctttgtcaagtctaaacccttaaaatctaagaaaaccgaacgctatatctgaaacgcaaacagattccgcaaaaaccgctttttttcttctgtctgtgcgacagaaagtgaaagtttttcgacattttttgcaggaatccatgcctttcctgagtggtaatacgaattggtgatcttccagaatttttccggataagcaagacggattgcaaggtaatcccgttcttttttcccaagattattcaccgaatcatacgctctcatcatccgatatccaagccgttcatcataatgatgcttttccatacatttgcgcaggaaataatacagatcttccatctgaacatcccggtgcgcatgttcaaatccagtcaccgccatgccctcctgacagaccagaagattatgataattatagtctccgtggaccatatgattttctgcccccgcttctttaaaaacactgtccagatccatattttccagtattttcagcactctgtctgcccaaaaatacatctggtcatatccctttaaaaatgcgatctcaaacgggcttttcacacttcttctgcagacaaattcccgaacctttctgagttctctgttatgccttgcatactccttgatcaccggattttcttctcttcctgcaaatccgttttcttccccagccagacgcatgcatagatggatccgggcaagattttccgcaccggcgatcagttcattttcacgtctgacatcacactcacgtccctgaaaccatttctttaagatatagcctgttccatcctcggctttactgacataagcatcctctttattaagcagaggcgtatctacccattcaaatccattcgaatttaactgctcatatatttttgcaagcgcacagatccgactctcctccatgcgcgtctccttcaagaggagcagccccttatctgtatcgcataaaatagcaccccttactttgtgggtgccgaatacttccatctgatattgtgtcaatacactgattccataatctttcatggcttccccctgccgctttgttttaccggtctttctaatgtatgcagggggagacttaagtcatgcatgatttttgattattccagttcttttattctggcaagtaaatattcccgtgtatttttctccggttcctcgatcacttcctgtaaaagtgtctggagtgtctgaccaattttcggtcctttttcaatacctgccgcgatcagatcctgaccgtttactttcagttcttttaaagaaacacattgctttttctccagaatctcctggtagcacttctcgataccagccagattttccagcttcttatcgcgctgataatcactctgtgccaacgtatcagccatccgtaccttcatataatacgggaacagttccgcactgatccggttcattgcgcggcgtacatgcttcatcgttgcaggcatccggtcatcatgatacagcaccagctttgacaccttacgcagcgtatcattatcaaatttcaagcgatgcatgatcgactttgtgagttcttcgctgacgtatgcatgccctttaaaatgtgccgtcccatccggatcgaccgtctttcgtgccggtttccccgtatcgtgaaacagcattgtaagacgcagcactttatctgccggaatattcatcagcgcatggatcgtatgctcacctacattataacagtgatgcaaagtttcctgcgttgtttccatcattgcatcgaattccgggaggatcacctttgtgatcccaagctcatatgcatcctggatcttttccggatgatcggagaccagaagctttacaagctctgtctggatacgttctgcactgatataggaaagatttggtgcaagttttcggattgcctgtctggtctctttctcaatctcaaatccaagctgtgccgaaaaacggatcgccctcaaaatccgcagggcatcctccgaaaaacgtgcctcagcatttcccacacaacggatcacaccttttttcagatcctccatcccatgaaacagatctaccagtccgtcctgttcattgtacgccatcgcattgatcgtaaaatccctgcgcagcagatcctctgacagacttctggtaaactgcactttactcggatgccggttgtcttcgtatttcccgtcaatccggtatgtcgttacttcaaatccttctccatttaaaagcaccgtaatcgttccatgctcgattccggtgtcaaaagttctggcaaataatgactttgtctcttccggcgctgccgatgttgtgatatcccagtcacccggcacacgtccgagaaaagaatcccggacgcagccgccgactgcatatgcctcaaagccatgtttttgtaatgtagttataattcgattcaccttttcaggtaactgaattttcatatacattcgctcctagtatgcttttccaaaataaacaacatgtttagcctgtttgccacaaaaaatacaggtatctccgtcttttacctgatcctctttgcagatacagcgggtggttgctccacctgttgctgccttgatctcatcttcacattctgcgcttccacaccattttgctttgatgaatccacgtttggtgttgaatttttcattcatttcatccatggtttcagcaaaatcaatgtggctgtcaaggaatgcttttgcacggtcatacatatccttctggattgtttcaaggatctcgccaagttttgtctcgatctcatccaaagaaacaacgatcttttctcttgtatcacgacgtacaacaacaacctggttctgttcgatatcctttggtccgatctcgatacgtgtcgggataccaagcatttcctgctcactgaatttccatccagggctcttctcagaatcgtcgatcttcacgctgtagccagcttttttcagtctctctgtcagttcatttgctttttcaagaacgccttctttgtgctgtgcgatcggaatgactcttgtttgaaccggtgcgattctcggtggaagaacaagtccgctgtcatcaccgtgaaccatgatcagggctccgatgatacgtgtagacagtccccatgaagtctcatatacgctgtgaagttcattgttcttatccagatatttgatgtcaaatgcatccgggaacgcatttccgaagaaatggctggttgcagactgaagtgcttttccgtcatgcatcagagcttctacggtgtaagtgtcctgtgcacctgcgaacttctcgctctctgtcttcggacctgatacgaacgggattgcaagggaatcacggatcagttcctgatatacacgaagcatggtcagtgttctctgttctgcttcttcataagttgcatgaatggtgtgtccttcctgccataagaattctctggaacgaaggaacggtctggttgtcttctcccagcgaagtaccgaacaccactgattccatactttcggaaggtcacggtaagactgtacggttcttgcccacaggtcgcagaacagagtctccgatgtcggacggatgcacattggctcctgaagagtctcaagaccaccttttgttacccatgcaacttccggtgcaaatccttcgatatgatcactttccttctggagaaggttctccgggatcagcattggcagatatacgttttcaacacctgtctctttaaatcttttgtcaaggtctgcctggatcttctcccagattgcatatccatttggaagataattaagacatccttttacacttgaataatcacaaagctttgcttctcttacaacgtcggtataccactgtgcgaaatcttcatcacgagaggtaatcgcctgtacaaatttcttttccttagccattgataagttctccttctcttcatttttgattttataaatgatattgtggtcaaaaagtattttgacccctttgataccagattgctgctctctgcagcctctgccggatgcaggggattcagatcagacatgctttgcccgtaaaataaaaaacaccaaatcttcatgcccctgacaagggaccgaaaattcggcggtaccaccctaattaatcgtattacgattcacttcattacccgttaacgccaggcatacgccacacttttcatgcggaactccaaggtcggttctataatttccatgcagcttcctcccaccagccagaagcctctctgcgccactttcatcatatactagtcctcttcatcgtcaaatctcttcgatttactatagagtttaattgagattttcggatttgtcaacccaattgacaagccctttccgttatgttttaatcaaagaaacaaaattttcgcatatggggaggaattattttgcaaacacctgaaattctatatgaagacgaccagattctggtctgccacaaacctgccggtgttcccgtgcagacaaaaaagatcggtacacaggacatggagagcattctgaaaaattatctgttcatccattcttcacatcatgccggacataagccaccttatcttgccgtgatccacagactggatcaaccggtttccggcatcctggtttttgcccgcacacctgcggctgcgaaaaatctgaaccagcagttacagaacgatcaatttgaaaaatactaccaggctgtagtatgtggagcccttccggactccggcactctgaccgattatctggtaaaggacggccgcaccaacacctcccgcatctgcagtaaaaatacacccggtgccaaaaaagctgtcctttcgtatgaaatactggaaacttccgaagtgactggcttatccgttgttctgatccatctcggaaccggacgccatcaccagatccgtgtccagatggcaggtgcaggcgcaccactctggggtgacaacaaatataacccggaatttgtaaataaaagaggatatttcccgattgcactgcgggctttccggctttctttctgccatccgaccaccggaaaacgcatggaatttgaagtcccatgtaactgggaacagttggaaacaaaagcagattggaatggagaatacaaaaaatgaacttattagaagaattcaaaaaaaatcccggattcgtctaccgaatcgggactgattactattatataggaaaatggatctgcaagccatgcacagacgaagccgttacagactgccatgccatgtatgaaatgtgcatccaggcaaaagaacaggcaaacgcagccctttattttcagaagctgcgtgcctacagtgaatttgccctggacattccatacaatccggcaaagatccttcagtaccagaccgctcttgtcgaagcactttccgatgctgatatccagtctcttaccgaccagcttcggcattttcacgatcaagcatcttaatcacatccagaagtgtaggatacacataccggcataatcctctcacttcttcatccggctgtgcaagatccgggatcatcaccggaatcatacccgcagccgaagccgagcggattcctgccggtgcatcttcaagcgcaatactatgtaccggctcggtgccgatcacctcgcacgctttgaggtaaatttccggatccggctttgcatgtttcaccgaatcgccaaaaaccccgccatcaaaatatttccacaaaccgactttctcaagagatgcctttgcgtggatctctctggaggatgtcgcaagtccgaccttgtatccgtgttccttcgcatagataagaagctcccttgctccctcttttacgccaatcccttctttgtcacaaatgccgtaatacttctcccgtgtcagctcattaaacttatccatcggaaaatcttcgccatatacacttttaaaatatgcttctctgcggaccacattgaatcccagcgtatgataaatatgctccccgatccgtccgtatccgagcttctctcctgcataattccaggatctctgcacaacacgttccgaatcaaggagcagtccgtccatatcaaataccagtgcttctaccttcatcagaattcaattccctttccgagggcatcttttaaatacgtggttacgtcttccagtttttccagaatttcttcacgttcttcccactcttcgccggtcatatctttgctgaccagtgcctgcttgacatcttttaattttttgatcaaatcttctgtcatagtaaatcccccttttcttatcaattactgtttttctataaatttattttaccgatattgtcagcaaatttcaacagttcatccgaaaatgtaaacaaatcttaacattcgccgctataaaaaactcttagctaacttccatttttctacttccattatataacaaatgtgctataataattcagtatgtaaaaaagtgttataatcataaggggattaagaaattggatgacaacaaattagaagcaaaactgctgaagattaaagcgcttgccgaacggggagaaggtggcgagaaagaggccgccatcaaaatgtatcataagcttctgaagaagtatgatattgatgaaaaagcattacaaaaagacaagctcagcaagcactggtttacatatgagacagatatcgaggaaaatcttctggtccagattttttacatggtgaccggagatcccgaatatttccgccggacaagccgtacacgcggaacccagtgcggatgcatatgtaccgattttgagaaaactgaaattcgtttttattttgaattttacaaagatgcactcaatcaggaactggaagcctttttgatggctttcaaattaaaaaatcatctgtttccggatgaaagtgcaaggtgctttgttcctgaggaagaggaagagatatcagaaatgctgttaaaagcgcagaaatttgcagaagatattgataagtccaacccggttcgccggattgcatctgccgatctttctgctgatccggatgcactggaatcataggtatatacgtcgttcttttgcgatatgcattatagcaaaaaagctgttcttaaaacaggagggtatgactcatattaaatcataccctcctgttttgatttctcgcgctgtatctgtgataaaacttatcttctgtacaatctatagcctgcagataccgccttaacaactcttttccatctgtctgaccacctaggcaagattccgaagccttgcaatttcttctttatgccccgcatcatccagtggcgtttccagataaaacggcagatcttttaatttcgggtgacgcataacatttaaaagtgcctctatcccaatctctccgccgccgatcaccgcatgccggtcttttcttgaaccaaatggcatcatactgtcatttaaatgaatcgctctcaaaagctcaagtccaagtactttgtcaaactcttccagcaccccgtccagatcatttacaatatcatatcctgctgcaaacacatgacaggtatccaaacagattccgatccgctccggatgtgataccccgtcgcggattgctttcagctcttcaaatctccagccaatctctgtcccttttccgctcattgtctcaagcagaaccgtaatattctcttttccggtaatcgcctggtcaagccccgcaatgatattctgaattcctgcttctgcgccaattccggtatggcttcccggatgaaacaccagattctcaatccccagtctgtccatccgcgtcacatcctcccggatcaccgtgcaggcgaattcatacacctccggcttcgcactcgccagattcatcgtataaggtgcatgcgccagaatcgctccaaaaccggcctctctcctgatcctctgaaactcctccgcttccttcaccgtcggatccttataattcgatccccgcggattcctgctgaaaatctgcatcgtatctgcattcatctttaccacattctctgcagttttcacaatccctttcgcaatcgacatatgtgttcctattaccatatttattagatcgctctcgtatacttcttcagccattctttctcttcatcattcagataaggagacaccttctcatatacagttgcatgataagtattcagacgttccttgtcttctgcattcatgatatccggattgatcgcatccaggtcaaatggcacataagtaatcggttcaaaatacaggaattctccatactcattcttctcgccttcacagacaagcaattcattttccagacgcacaccgtgagatccttcgatgtagattcccggttcatccgtaatgaccatacctggctggaatgcatcagactcaccggctctgtaagtataacggaagcctgccggtccctcgtggatgttcagaagatatccaaccccatgtcctgttccgtgattgaagtccagtcctctgtcccaaaacggctttcttgccagataatcaaagttcattccgcagcagcctttcttgaagatcggacttgcaaggttcaggttactgatcgcaaccagtgtaaaatgatctttcatgatctgtgaaacttctccaaaagcatatgttctggtgatatcagtagatccttcgtagaatcctgctcctgtatccgtcatcaggaaagttccctcatgaagctctacattggtctccggtgaagaagaatagtgtacgatcgcactgtgctccccgaatgcagagatcggtccgaagcttggacggataaatccacccatctcggcacggaactcatccaatttgtcagaagcgctcatctctgtgatcgtctctttgccaacattttctttcagccatttcataaatctgacatgagccacgctatccttgatctcagcgatacggatattttcgacctctgtcggattctttacacatttgaataagatcgccggatttctctcttccactttcttcacattctccggaatgttcttgtaaagtgcaaagttcagtcttcccggatctaccatcaggacttcttctgctgcaaccttcttgatgtcctcataaatatcattgtatgggtgcagaataaccccgtctgctgcaagatgtgctttaatctcatcgcttaattttttctcattcacaaaaagatccaccttgtccattctgatcactgcataggtcagaaccaacggaaaatattctacgtcatttccacgaatgttcagtgtccagcagatgtcatccagtgtggtaagaacgtgtgctgtcgcacctgcttctttcattgccgcacgtgtacgtgcaagcttgctctccacagtctctcctgtgtatttctgttccagttcaaataccggctcttctgaaagaatcggacggtcttcccatacttcatcgatcagatcatatgcataaacgacctttccgttcttctcagatgcgatcttctcgtattcttctccttctgttacagaaacaacacgtccatcaaatcctacagtttcgccttctgccagagctgtttccaaatattccccaatcttcggaacgcccggctgtcccatcttcatcagttctactgttgttccctccagctgctttgccgcctggataaagtatcttccgtctgtccacaggcgtgcttctgtctttgaaaccactgctgttcctgcagatcccgtaaatccggtaatatactctcttgctttaaaatgctcccccacatattcgctctgatgaaaatctgcagtcggaataatataaatatctattcccttttcctgcatttttgcacgcaatttttcaagtctttccggtattgtagacattttaaaaaacctcctttaatttttccattctctgaccattataacccgtaaacttttgaaaagcaacctaagaaaaggagtcggattcggcaagaacatcattttcattcagatcctgtgcactgcctgtaagtccggtcgcaagtaccgctacacatccgattatcttcaccttttttgacatctcccatcacctttcgcaaattttcacaaatggtagtctacccgaaaaatttgttctgtctatgggaaaaatgtgatttttcttgaaatcaggactgatgcattgctgcatgctccttttccagttctttaaaaagttccggcacagtccactgactgtttgtgtctgtcagaaccgctttataatcaatacgtttcatacccttctttcgcatcataaataaaatctgatccagatggctgcctgtcactccggcaaataccatcatctcatctgccagctcttcaccctcataaatcctgtctgtctctgacgcttctttcattccggcaagtacaccaaccgtctgaaaatactcttctttttttatcagccgcacccgaatcctgagtgacatacagatcatctgcagctcctgcgcacgcttcttatcttttatattaaataataatactgtttctctcataaatttcctcgactactccgcttttctcaaacggttctttttatgtttattccactctccgattacctcactgacagttgataccgtaacaaacgcactctggtctgtctcatggataaatgcaagaagctttgcatattcactcttttccagaattgtaaccacttctgtctgttcctgattgcccagtcctccgactgccggataaagagtcgcccctctgtgcagctcatgtacaacaaactgctggatctccggatatttctttgacaggatacacaccctcttacggatactgaaaccatcgataaaattatccagaacaatcccataaagataagttcccagaaggctcactaccagtgtctttctgtcgtagacaaggatagacgtcgcagcggtcacaaatcctgcgatcgtaagactctttccaatttcaaaatgcaaatatttatttaaaacttttgcaacaacatcaagcccaccagaagatgcattgacattaaacaaaatcgcctgtccaatgctgatcaccagaatatggcacagcatattgataaacatatcatccgtgagtggcggaacatctggtgtcactgtttcaaaaatacgcagataaaccgggagcattaaagatgtaatgaccgtcttacctccgaattcttttccgacaaacacaatccctatgatcagaagtgctacatttagaatcatcgtcatcgtcgaaaccttcagcggaataaaatttgccagaaccatgacaagtcccgaaatacttcccacaacaaaggaattcggcatcatcagataatacactgatgccgatacaataaacattcctaccgtgatcgttgcatactctttcaatatgttttttgctttgttcttctctttcaattttctttcctctctttcataccggtgcctcttatttccccaaatatgcggcacactatattttccaacatagcatgttcatcataacatacttctcatcaaacttctacgctatgtttctcattaaaaacatgaaatcttctttccatttatagtagtttcaattataataaaggaagagtgaattttttaacaatttagagaagagagggtttattatgaatgctgatggaaacgtaatcaaaatcaaacatgacgtactgttcgaagtagcaaagcttgcttttgcaggtgaacttgaagaacagcgtgatcacctcccgctgaagcttattccgggaccgaccccgcagttccgctgctgtatctacaaagagcgtgagatcatccgccagagaatccgcctcgcagaaggcaaagctccgggaccggaagatgatggcaatatcatccaggttatttcttctgcctgcgaagactgtccgatctccagctacacagtaacagagaactgtcagaactgtcttggaaaggcatgtatcaatgcctgtaagtttggggcaattgaaccgggacattaccgttcccacattgacgcatccaaatgtaaagaatgtggtcagtgcgccaaagcctgtccgtacaatgccattgcacatttaaaacgtccgtgtaaattcagttgtccggtcgatgcgatcacctacgacgagcatggcatttccataatcgacaaaaacaaatgtatccgttgcggtaaatgtatccacagctgtccattcggtgcaattgcttccaaaacatttattgttccggtaatcaatgctttaagagaaggcaaacacatctacgcaatggctgctcctgccacagaaggtcagtttggtgctgacattaccatggaaagctggcgcaaagcaatgaaagagctcggattcgtagatttctacgatgtaggactcggtggagatatgactgctgcttacgaagctgaagaatgggctgaagcttacaaagaaggacagaaaaaagtaacctcctgctgccctgcatttgtaaatatggttcgcctgcattacccacagcttgctgacaatatttcaacaactgtttctccgatgtgtgcaatttcccgtatgatcaaagcacaggatccggaagcgatcactgtatttatcggaccttgccttgctaagaaatccgaagttgtcgatcagcagatcgaaggaaatgcagattatgttcttacatacagcgagatccgtgcgatcatgaaagcaaaagacgttgaactcgaggcctgtccgaacgacaaccagaccgcttctaccttcggaaaacgctttgcaaattccggcggtgtaacagcagccgttctggaaagtctgaaagaatctgacaactgcatcgatgcgaaagtctgtcgtgcaaatggttctcaggaatgtaagaaagccctccttctcatgaaggttggacgtcttccggaagacttcatcgaaggtatggcatgtgacggcggatgtgtcggcggtccaagttcattcaatgaccagatggcttccaagaagaaccgtgatgccttgatctctcaggctgacgatcgtggaattcttgataatctgaagaattacgatatggataagttctctatgcatagagactaaaattataagggcgtgtgaaaaatgagaaatcatttttcatacgccctttttaacaaaaattcttattcaaatgcatcaaaaatcgtgcaggcatctatttattatcccctataccacggcagcctgtcccgcagcatcatcttttccatccgctccagattcttatccgaatgctcaatctcccgcgaataccggtacaccagctctacgatctcttctggtgtaagctctccttcattttttatccaccgtgctttccacagctcataaatatggaaagtacttattactgccatctgcaccttcgcataaatccttccatcataaactgcgccacagaaataagtgaaaatgaaatacaccagcagctgctctgcctggatctggatattgctctcttccttcgcccaccgcttaaagtcagacgagattcctttatacgcatctgctccatgtgaatacagaagttcttcgctctccatcagaagcatatcccagtcctcacgtagaagttccaattcataaagttcccggaacatcttatgcgccatctcccatttttcctgcacagacggcttttcttctttccaaagtttccgtacaaactttctggcactctttgtctgataacgttcaatgacttcctcgcaggaaaataactgttcccggttaaatctgccctgcagatcatgcgccattccaagaatcagtcccactcttatttttaatgaatgctcccggtcctgcagaattccaagcattgcatctctcgcatctacaagcatagaatacagaaacggatcaaattcctcgtattcctcttctccttctttttcataagtaagaaaacggaccggctctttcttctccatcaaaatccttgccacctccggacaggataccgacagggtaatctcccgtacatcctcaaactcctcgacatgtctcggatacaggcggcaggttttacacagacttttctctccgagattcacatacatctcacacagattacagtcatttaaaaatgcacatcgcttttctttatcctgcctgaaaatgccacggatccagtccacggatttcaacatcgtaaaccagaattttcctttcacatgcttatacttattcagtgattttttgtcaattacaatcttccaccctgcacaacaggtatcttcacatttgtctgcgatgcaggtgaactctttataataatccggaattgtatattgcatttatttttctaccccaaccttcttacagatatccgccagacagcatctgtcacagtgcggcttcgtccttgccgtacaaacttctcttccgtggtacaccagtctgtgacagaaatcgcttccttcctctggcggaaccagcttccagagttccatctctactttcttcggatccttaatcccgtctaccagtccaatacggttcaccagacggatacaatgggtatccgttacgatcgcaggctcaccaaatacatctcccatgatcaggttcgcgctctttctcccaacacctggcagctttaagatcgcattaaaatccttcggaatctttccgccatactcatctcgaagcatcttcatacaggcactgatatcccgtgccttactttttccaagcccacaaggacgtacaatctcttcgatattatttacatctgcttctgcaagtgcctctactgtcggatattttgcaaataaaccttctacgactacatttacccttgcatccgtacactgtgccgcaagacgcacactgaccagaagtttccatgcctgatcataatccagagtacagtctgcatccggatattcctttcttaagcgttctattacttccaatgttctctgtttctttgtcatcttttttatccttctttatcttatattttgtatagtaagataattcatctgcttcattagtttaagatcttctttgttaaatgtaagaagattcataagcttttctttatttacaatttctttttccgaaatcactgctttaaaggtcaccggaagcatcgtataattggagagaccggacaccagtgccagctgctgtcccggattcaccagattatttacacaggagatcatgatatgttctgatttcagagcctggttatgaagcatataggttccgataaatccttccttttcatactcaccagtataaagtccgccacattcccccggttctttgacctcacttacatcattaaacaaatgcactttatatttgttattctttccttccaccgcctgctgttcaatcaaacttttgacaattacttttccaatcccgtcatagctgtacatgtacaatttttcaattgtctccgcataagtacattcttcctcttcctcagcaatctcatctccgataattgcaagaggtgacaccttaaaaatcttagacaattcaagaaatgtcgaaatatccaatgaaatatcccctttttcgtatttagaaactgtcgacacactcttatgcagtcttacagcaagttctttcagcgtcatattatatgccatccggtattttctaatattacgccctaccttctcatctacattcataccaattttctttcctttaaatcaatttttttatgatatgtgcataaattttaacgcatttccccaattttctagtatgcaccatattttttctcttttttcaataataacacgtctgattttttcgtgtcaataaaacgcacctcttttgtcttttctgatttacccggataaaatgatagcataaaaacacaagccacggagtcatccgtatgacaaatatgtggaaggagaatacaaatgaaagtagaaaaaaggttactcaaatacatcgcaatcaaaacaccatgcgatgaaaacagcgatacagttccaacctctcagtgtcagtttgatcttgcaagaatccttgctgatgaactgaaaaaactcggacttgacaaggttgttctggacgataaatgcttcgtttatggaatccttgcagcaacaccaggatatgaaaataagaaaaagcttggacttatcgcacatatggatactgtaccagaattttgcgaggcagaaatccatccggtctgtacaccagattatgacggatgtgatctcgttctcggagacagtggacgggttcttacaaccaaagatttcccgcatctgaaaggattaaagggacgtacactcatcacttccgatggaaataccatcctcggagttgacgacaaagccggtattgctgagatcatgcagcttcttgagatcctgatcacagaaaagattccgcacggacagatcagtgtcgcatttacaccggacgaagaatgtggcagcggcgctgcacattttgattttgatacttttgacgcggaggttgcctatacgctggacggggacggcgaaggcgagatccagtatcagaacttcaatgcatgcgaagcaaaatttgagatcaatggcaaaaatgtacatccgggttctgcaaaagatgtgatgatcaatgccgttctcattgccgcagatatcaacaatatgctcccaagattcgagattccgcgtcataccgaacagtatgaaggattctaccatcttctgagcatacacggagatgaaggacatgccgtatccgaatacatcatccgcgaccacgacagcgcaagctttgaagcccgctgcaatacgctccgccatatcgaaaagatcttaaatgagctctggggcgagggtacagtcacactgacacttaccgatgaataccagaacatggaatgtatcatcaaagatcacatgtatctgattgattatgctagagaggcctgtgcgaaagcaaatgttccggaggatatttctccaatctgcggaggtacagacggctgcaagctttcctttaaaggtcttccttgcccgaaccttggaacaggcggacacggatatcacggaccactggaacacgtcaccatcgaaggtatggaagcagctgtccgtgtcattgtagaacttgtaaaaatctttgcaaatgagtaaataccaaataggaaacggagatactgattatgaaaaagaaaaaaatatctttcccttctgcgctcactgtattatttatcgtccttattttcgctgcaattttaactgcagtggtaccggcagggctttattccaaattaacgtacaacgcagaccatgatgtatttgaaatcacaacaccggaaggtgaagtaacagaaatgactcctacccaggaatccctggacgagctgggtgttaccggaaacttaaataaattccttgatggaagtatcagcaaaccgatcgctgttcctggaacctacgagagagtcgatcaggaaccacagggcgtatttaaaatcctccttgcagcaatcagtggtgtttacgataccattgatatcatcctttttgtatttatcctcggcggatgtatcggtgtcctgaattatatgggtgcattcaatgcggcaatcgcggcactttccaaagtcaccaagggcaaagaatatatcctgatcatcctgatcacgattattatcgcagccggtggaactaccttcggtcttgcagaagaaaccattgcactttacccgatccttgtaccggtattccttgcagccggatatgatgttatggtttgtatcgctgcaatttacatgggatcttctatcggaaccatgttcccgaccatcaacccgttctctgtcggaaacgcatccaatgcagccggaatcagccttgctgacggtatgggaatccgtggtgttgctctggtactcggcactctgatcactttgatctacatccttcgctatgcaaagaaggtaaaagaagatcctacaaaatcaatctgttacgaccagtatgaacatcatatgcagaaattcggtcatcagggcgaggttcctgaatttaccggaaaaatgaagctttccctcctcgtattcggcgtatccttcggtgtgcttgtatggggacttgtagctcagggctggtggttcgacaacatgactgccctcttccttgcctgcgcgatcctgcttgcatttacttcaggaatcgacgaaaagaactttatggatcagtttatcggcggtgccgctgacctgatgggcgtagctctggtagttggtgtggcacgtggtatcaacatcattctggaagacggtatgatttctgacaccatcctggaattcttctcaggtgcgatcagtggaatgaatccgatcgtattcatcatcttgatgatgcttgtatttatcgtactcggattctttatttcctcttcctcagggcttgcagttctgtccattccgatcatggctccgcttgccgacactgtaggtgtttcaagatcagcaatcgtatctgcttatgcatacggtcttggtctgatttctttcatcacaccaaccggtctgatccttgcatcccttgcgatggtggatgttacttatgataaatggctgaaattcatcatgccgctgatgggtatgactaccgtcttcagtgcgatcatgctgatcattcagttatatgtataagcttcttgcataaggaggtaaactcttatggattttgaaaaacaaatacagacagaccgtgaaagtctgatccaggatattatgaaactggtgtccatagacagcgtggaagccacaccggatgcaggaatgcctttcggtgcaggcgctgccaaagcacttgactgctttctcgaaacggcagaatccattggtcttaaaacagaaaattttgatcactatgccggacacgcagattatggggatcaggaagaaactctcggaatcctcggtcatgtggacgtggttccatgcagtggcagctgggtatgtgatccgtttaaaccggaaatcattgacggaaagctgtatggtcgtggcgtacttgatgataaaggtcctcttcttgcctgcctccatgcagtcaagattttaaaagaaatgggtgtgccactcagcaaaaaaatccgttttattgtaggtgcgaatgaagagacagactggaaatgcatggactattatttcaacaagaaaaagatccctgctccacagatgtccttcacaccggatgcagtattcccacttatttacgctgaaaaaggcgtctttcagtatcagcttgtaaccgatgtctcagaggatatcactttatccggtggaaatgcatttaacgcagtcgcagaccatgcttccgtcctgcttcctctcgaactggaaaccgtgatccgcaagagcctgctctcctgggagacacagaccagatgccatttcacagtagaaaatgcaggtgcatccctccggctgaccgcagaaggttttgccgcacacgcagcacatccttctaccggaatcaatgcgatcagcggactgatgtcaactttatctgagctttctccggaaaatgagttggcaaggattgccacattttacatggagcacattggttttgacctgaccggaaagggacttggaatcgatcttacagatgagatctccggcagattaagtttcaatgtcggaaaggttgaagtatgcgatcataaggtgattttctccatcgacaaccgtgtaccggttacttaccagtgcgcccaggttcaggagctcattcagaaacagcttatcggttccggattccgttttgagaacccatatgcaactgaatccatccacgtacctgaggattctttcctggttcagactctgatggaatcctaccgcaatgtcaccggtgatatgtccgcaaaacctctggtagacggtgcctgctcttacgcaagagcactggataactgtgtcgctttcggcgcactcctcccagaccagcctgatctgatgcatcagacaaatgaatgtctggagctggataaactggatctctggatgaagatttatctggatgcaatctaccggcttgcaaaataaacaataacgtataactaagagagaataacgtaatgcttttgttattttttacgttattctctctttttttgttcattttttgtttattatgtatattttctatccatttcacatacaaattcgatgacatcccagaacatttatggtataatttagaaaatctaattacttatttgttaagataccaggggcaagaggtcagaaagccgatgcaagcttgcttgcaagaggatttttgacctcttgccccgccaaaaacatgagtaagtagccatttttcaaagaaaaatgagtggattacgaatgtttttgaggattgcgagagtgcaaagcacgtagcaatctggtatcaaagggggcaaaaataccttttgaccccaacttcttgttaacgcacaatatgagggggattttacatgaaaaaattatcacgtcatgaactgatgcaatacggaacggctatcatttcgttccttattgtaatgacgttcacacttctgatttttttctggtttgtacaacagagcgttgataaaagtgtacagaatgttcttcaaaaaaacacactgcagcaaaaggatcacttggaactggttctggaaaaagaatatgaatttctggagagtcctgctgcatacttcggaacaacttccgatctgttcagcaacgataatcttcagcttcttgctgaactggcttcttccagctcctatcatcggcttatgcttttttctacagacggtatcgggcactccagcgatgggaagaagaccgatgcaagttcacgggactattttcaaaagacattggaaggcagacgcgtcattagttctcctctgtcaagcagcgtagacaacgaaacccttgttgtcctcacagttcctgtttatgacaaagatcagaatattatcggtgtctttggaggctccatcgatgtcacggaactgactaccatgctttttgaggatctgtattcgggttccggctactcatttatcacagacccggacggcaacatcatttccattgaatctacgcacaacgaaatccggaagaacttttttacttcttcctctgactgggtatttcagacttcggaagatggcgctactcttcaggaagattttaagcaaggacacgcaaactgccgcaagattatatcagatttatcatatgcacgctatatttcctaccagccgctaaagtacaacggctggatgctctgctatatcattcctgctgtcgatgcccgtcaaccctttgcttttatcaacaactttgaaatcattctgttcgccttttttatctgcattgtgctgcttctgatcttcgcactctggaagatcaaccagaagaatcagacttcgcttcttcgccaggcgcatacagatgctctgaccggacttctgaacaaagtttatgcagaacacacgatttccgaatggctacgcgaaaaagattttgaagatttacaggctttaatgatgatcgatatggattatttcaagcagatcaatgatacttatggacatgcaaccggtgaccaggtactgaaaatatttgctggatttctgaaagaacagttccgggcaaccgatatcatcggccgtgtcggtggtgacgaatttatgatcctgatgaaaaatgtacgtctggattacagtatccatctgcatttgcaaaagctctatacaaatcttcaaaatatagatatcccggaactaaatgaccagaaactttcctgcagtatcggctgtgctgttgctccaacggatgctgaatctttcagccagttataccgccttgctgatcatgctctgtacacagctaagcacaacggacgtggacgttttgttatttaccacgatatcaagaaccatcaggaaaccgttttatcctgatcaacgtcaggaattctggtacaggtcaatattcctgtcatttaatctcaaaattcccgccgggcagatcctgtacctgtccggcgggaatttcattcttctttatatctcagatatgccccggcacatccagtcatttttaatcatcgtaagtatccaggaaattgtgtcttacaccttttgccttgtaaccgacaaccgtatccagattgacattttccacactcttgaaaatattgccctccacaaacggattcgtcttcttaagctctgcaatcagctttttgatttccatacgctttgactgattttcttcattgttgcaggttgtacaggtatcggtaaacttacatgcacactggataaaatgcagatcattgtaatctctccatgccttgatgtcatcctcacggatcagatacatcgggcggatcagttccatcccttcaaaatttgtactgtgaagcttcggcatcatagtctgcacctgtgcactgtagagcattcccatcaggatcgtctcgatcacatcatcataatgatgtcccagtgcgattttgttgcagcccatctgctgtgcaaaattataaagatatccacgtctcatccttgcacagatataacacggtgatttttcaatctcaaataccgattcaaaaatattggattcaaagatctggatcggaatcttcatcttccttgcattttcttcaatgaccttccggttctccggactgtatcccggatccatcaccaggaactttacttcaaagttaaatttgttgtgacgctttaattcctggaaaagctttgccatcagcattgaatcttttccaccggaaatacatactgcgatccggtcaccttctttgaccagttcatattctctgacagcttttgtaaatttggaccagatcttctttttgaacttcttgcggatactaagctccacatgttcacagacatcatctgcttcctttttcttcatatctgccatcagccatccaacataaccgcccttcaggctgtatgcttcatatccctgctcctgcagttcttctgcgatatccctgctgatctgtcctctgctgcagcagataatgatcttcttttccttatcttccggcggattctccatcagtacatctgctgagcttgccgtcgaattcggcaggattccatgggcgcgctcaatctcgccacggatatcaaaaagctcgtaggattctgcaggaagcgcttccatttcctcgatcgtaatatctatactcattgattttctccttataaaaagaatgtcccctgacacataatcctctttattgaacagaaagttccatctggattattgtcaaataaaaaatgcgcatgtatcggtacatatcatagcataatctgtgcatctggtcaaagggagatccatccgaaaatactggatttccgcttatcgcacagcattttcaacactcctgactgccgcaattcctttcggaaatgcaagactgacaaacagtgaatagtaccagccaaatccggcattttccatcataatcccatatgccatgcttacgaaaatgtagctgcacatgatcggaatggatttcagaaaaacattttttctgatctgtgcctttgtcatagtgttttctccttaaaattttctgtgcacatcgaaaaagacgaaggtttcgaaaaacctccgtccaaaattcctgtgtgtataatatttatttgccctgaaccgctgcaaatccaccttcaagatctgcgatgatatcatcgatatgttctgtaccgatagaaagacggattgtgttcggtttgattccctgatcaagcagttcttcttctgtcagctgagaatgtgttgttgttgccggatggataacaaggctcttaacatccgcaacatttgcaagcagtgaaaagatcttcaggttgtcgatgaacttgtgagcttcttcctgtccgcctttgatctcgaatgtgaagatagatgctccaccattcgggaaatatttttcataaagtgcatgatccggatgattcggcagtgacggatggttcacatactctaccattggatgattagagaggtattctactactttctttgtattttctacatgacggtcaattctaagtgacagtgtctctgttccctgcagaagaaggaatgcgttaaatggagaaattgttgctcccatatcacgaagaaggattgcacggatgtaagttacaaatgctgccggacctgctgcatctacgaaagatactccgtggtagcttgggtttgcatctgcgattgccgggtattttccacttgctttccagtcaaatttaccggaatctacgatgattccaccaagagttgttccgtgtccaccgatgaatttggtagcagaatgtacaacgatgtctgctccgtgttcgatcggacggatcagatacggtgttccgaatgtgttgtcgattacaagcggaagtccatgcttgtgtgcaatttcagcgatcgcatcgatatccgggatatcactgttcggattaccaagagtttcaagatagatggctcttgtgttatcctgaattgcatcttctacttctttcaggttatgtgcatctacaaatgtagttgtgattccgtaatgtgtcagtgtgtgttcaagaaggttgaagcttccaccgtagattgtcttctgcgctacgatatgtccgccatctgctgcaagtgcttcgatggtatatgtaattgcagctgctccggatgctgttgcaagagctgccacaccaccttcaagtgctgcaattctcttttcaaatacgtcctgtgtagagtttgtcagacgtccgtaaatgttacctgcatctgcaagtccgaatcttgctgctgcatgtgcagagttcttaaatacataagatgttgtctggtaaatcggtactgctctggcatcagatgccggatctggttcttcctgtcctacgtgaagctgaagtgtttcaaatttataatcgctcatatttttctacctctcttttctactgtctgatgtatcgtgatctctatagtgatctttcaaatttgatagttgcattatatctacttttacctactttgtcaataggttaatagggaattattttaaaaacatttaatttcaatatgttttatctgtttttcttctatcaatataaaaaagacgcttttggcgtcttttctgtataataacatccactactgttcatcggtgatcagcccggcgatcagttctgctcctgtcacaagatctttgattgtcgtatattcatttaccgaatgtgcctggtacattccatttgacagcaccagtccaggaatcccgttcttcgcaaagctgttgttatcacttccgccaaatgtctctacaagatttcctgcaagtcccagctctttgcttactctttcaaaccgttttaccggcacactgtcttttgctgtctcataagcgatcagatgaacttcgcaggtaagttctgattcggctccgtgtttttcagccacctttttgaaggtatttcccacttcttctacacaacgagtcgctttttcatgagaatagctccggatttctccctttacaatacatttttccggaacaatgttcgttccgctcccaccttcgatcaatccgatattgcaggttgtctcttcatccacatgtccctgactgatctgcgtgatcgcttcggatgcaatagcaatcgcatgaacgccgtgctccggatcaaatccggcgtgggatgccttcccggttactaccacctgataagaaatcagagacggtgctttatatgctgcgcttccaaccggtccgctgatatccagtacataggcttcttttgcacgaacctttgaaaaatcaaatacgttgctacccttgatataaagctcttctgcaattgtaaaaagaatctcgatatcccggtgtggtactcccgcttcttttacactgcggattccttccaggatctccacaagtcctgccacatcatcagctccaagaactgcttttcctgcggaacggatcacaccgtcttctccgatgatccctttcttgcctttggacggctcaaccgtatccatatggccggacaaaaggaccgaatctcccggaagatctcccggaagatatgcatataagtttccggcgtttcctccgaaatgttttccagcattgtcttcctctacttcaaaaccaagttcttttaatttcacgatcagccggtctgccatctgacgctccccaaagcttggtgcatcgatcgcagtcagttcctgaaattcatcgactgcccgctgttcatttacctttattttactcatttctgccacttccttatctgcacggtcatattccatctgccggctatctgtccggtaatacaccttcggtcacagatatcttccgctttatacacaattctatttgatttactttaatacagcttccagatctgcgatcagatcctctgctccctcaattccaacagacaatctcagaatcctgtctgtaattccgttccggtcaagctcttctttggaaagatccgcatgcgtctgggtgatcggataagtgatcagagtctcagttcctcctaggctttccgcaaactggatcagttttacattttccagaatgtgatatgctctctctttggaatctacttcaaaggtcaggatcgaaccaaatcctcttgcctgctttttcatcagttcgtagcccggatgtgattcaagtcccggataaagcacccttgtcacatactcctgcttctccagaaaatgtgcaatcttcagtgcattttcctgtgccctgtccatacggactccaagcgtcttgatccctctgaggatcagccagctgtccatcggtgcaagggttgctcctgtcgtcttgatgataaaacgaagctgttcctgaatgtcctcgcggtttgttatcagaaaacctgcaagtgtgtcattatgtccacccagatattttgtcccgctatgcacaacaatgtcagcaccaagcttcagcggattctggaaatatggtgataaaaaggtattgtccacgatcagaagaagttcatgtttttttgctttctttgaaagttcttccagatcggatacacgcatcatcggattggtcggtgtctctgcataaattgcttttgtgttatcctgaatataatcctctacatccacactgcttaaatccacgctggtaaatgtcagtccatttttcacattgatgctgtggaacagacggacgcttcctccataaagatcctcatcaatgatgatgtgatcgcccggtttgaaaatctccatcagagctgtgattgctgccattcctgtcgaaaatgccagtgcatcaatcccttcttccagcgatgctacaatcttctcaagatgttctctcgtcggattctgtaatctggaatagtcataaccacttcctccgcctactctgtctcttgcaaatgttgcagactgatagattggataactgatcgccccatatatttcatccttattatcgtcagccagatgctgacatcgtgtatcaattccgtacttcattcttgtctatctctcctgtttctataaatcaatgttgctatttactgtacaatatctttctgccaaaatccagttttcttttcataaatttacgcaagttctttctccgtcatcacacattcaaactctccggagccgcttacctgtgaaaaatctgcggtatagccgagcttttcatagaatccaagtaccgcttttctggaattgatatagatttttgtcacacctttttcgcgcatccagttttccgcctcaatgatccctgcctgtccgtaatgtcttcccctataggattccagtgttgccacgcgctcaatttttccggtatgttcatccagataatgcagcctgcaggtggataccggataaattccgtccatcaccagaatatattcatcttccggtgtgtcatctgaaaattctccctcaagcgggatcttaaatcccaggcacattgcctgtgtccgcacatagtgtacgccggctctctgccattcttctgtcactctgactgctttcatcattcattccccgctttctttattttccggataatttttctcttccgtgtggtgtcagccataaggattcatccggtccatttggcacgatcgcaaactcattggacgggcagcaatcgatatgataatgcttcttgatcgccgcaaaattcgttgtatcgccaaatcccggtgtctgatacaaatctcttgcatatgcccacagattcggataatcgcggagaagctttttattcagacgaaataccggataatatgcacagtcaaatcgtaccagtgtcacataaagacgcacatccgattcagtcagtctgtcaccaaataagtatctctggtttgcaagcctttcttccaaccagtccagacggttaaataccatattgtaagcacggtcataagccttctgttttcttgcaaatccggctttatagacaccgttatttacctcacggaaaatgatatcattcagcttatcgatctcttctcttaaatcttccggataaagatccggtgctccctctttgtgataaggcttccatgccgtctcaaagtaaagtgtcagattgaaataatcattatttaccaccttaccggatgggatatctacaagtgccggtacggtaaatcgtccggtataatccggatttgctgcaagatatgcctcactgatatagtgaattccaagaaccggatccacatctccctcgtccagtgtaaatgcccagtcacttctcggcacatccggtctctttggatctgcggttccaagactgatcacatcctccaatcccagaagtcttcttacaatcacactacggtgcgcccacgggcataccggcgcccacaaaaggcgataacgtcccggctctaccggaagctttccttctccctcaccaaacggtgtctcaaactgattcttctggcggttgaaatttccttcactgtctacttctttatttacccattctgtcgatgtattttctctcataatcctttccctttcctacgctgtctaattctgtttttcctgctcttgtctgatactcattgctttcgctcccttcttttatcctgttggaaaaaatcgactgatccctcagccgattttgttttttctcttaaattgaataatccggttcttccatccggttaatctttgtaaagaactctttgacacgttcgttctttggatttccaaacacttctctcggcgttccgtcttccaggatctttcctccgtccaggaagatcactctggttgcaacgtttcgtacaaagctcatctcatgggacaccagaagcattgtatatccttcatttgccgcttttttgatcgtatccagaacttctccgacaagctccggatccagtgcagatgtcggctcatccagaagcaaaagctttggctccatcgcaagtgctcttgcgattgccaccctctgctgctgaccacctgacatatgtctcggataatggtttgcgtgatccagaagacctacatttttaagctgctctctcgcaatcctttctgcttcctcttttttcatcttctttaccacgctcagcccctccattacattctgaagtgctgtcttctttgaaaaaagattgaaattctgaaaaaccatgccggtctttttccgaagctctgtcagatctttgccatgaatatgtgcaagatcctgtgtctcaccgtcaatcgttatagttccggtttccggtttttccagtctgtccacacatcttaaaaatgtggattttcctgttccagaaggtccgatgattgctacgacatctccctgattgatggtaaggtcgatcccatcaagaaccttattatttttaaatgtttttgatatatttttgatttcgatcataccttattccacctctgtatctctgatatctaaaagtgccggtgcatcttccggtacccggagcttcttctcaagatagctgatcactctctcaagtacgaaagtaattacccagtaaataattgccagtgagatatacacttcaaagtaacggtaatttcttcccgcaagaatctttccttctgcggtcatctccactacggaacagacaaatgcaagagaagttcctttgatcagtccgataaatgcatttccaagggatgggagtgctaccacgattgcctccggaaggatgatccttatcaatgcctggaaataattcattcctaaagcgcttgctgcctcaacctgtcctttatctactgattcaagggacgcacggatgatctctgcgttaaatgcagattcattgagtgccagagcaacgaatgcatatacgattggtgcgactccattgacattgtagttggttccacatttaaagttgatatatttcaggagcatcggaataccgaaataggtcacatataactgaaccaggatcggcgttccgcggatgaccgagatatagatacttaccagctgtttcagtaccggtacctttttaatcttcacaagtgcaaggagcagtcccaggatgagactggcgatcattgccgtgacagccagttccattgtgaccggaagatattttaaaagtagcggtatctgtgtaaataccagttttccatcaaataatttacccattagttaatcgtctccttgaacttatcatcctccggtgcagtatcctgaccataccattttttactgatctcagtcagggttccgtcttccttcagctccttcagcgctttgtctacctgttctcttaaatctttctgatcctgtgggaaaatataatatgcataagagttttctgcaatcatttttgcttcatcttccggaatatcatttttctgcacatcatagttaaattcttccatgtaagagttgtacattgccagatcgatgattgtaaaatcctgcgatccgtctgctacatgctgtaaaaatacagatgtatctgcatccgagtaagtaatattgatcgctttatccggattcttttcattccatgcttctactgcattggatacgctgattcctgtaccaccttcaaaagaaagtcctgctgcatcttcaaatgatttgatctcttttccacctttctttgttacgaatacatagctgatcttgtcatatggataagagtaaagataacttgctccacggtcttcgttgtaagagaagttgttaactccaatctgataatttccactgttcagtccggaaagtacagatccaaaatcagtcacttcatattccagttcataatccggaagtttatcaaaaactgcattcagtacatccacatcgtatcctgccggcttgtcatcatcgtctacatagacatatggttttgcgtttgctccggttgctgctttgattactgtctttccactgtctgaagagctgtcctttgaagcgcttcctgaagaagatccgcatcctgtagccaggactcctgctgccagtgtaactgctaaaatgcttgccaactttttcataatatttttcctcgtctttcgtctgttatttttctgctttaaatttgtgtgtcggatctttactgagtgattctcttcctgtcggtgtcttccagatagtatcccagtctgtttcctgcaccacgatatcatagtatgtattttcccaatactctgcatctgcttcattcagatcgacagatgccgcaaaatccttaaaatatgtgttatgtctgaatgccgggatctgatacagatctcttgcatatccccacagattcgggtaatctaccagacggtgtttgcaaggtccgatatttcttgaataagacacatccagtcttgcgatggttgtataaagacggatatcactgtctgtcacataatctccgaataagaatctcttgtctgcaagtctttcctccattgcatcaagccctgcgaaaaatgtctcatatccatcggcaaatgcctgtaaggattcagcgaactgcgctcgataaacagcgttgtttacattttcaaagagccatttgttcagcttatcgatctctggtcttaattcttccgggtaaagatccggcgctccctttttttggaacggcctgaacgctgtttccagatgatttgtaagccagtggtaatcattatttaccactttctttgtcttataatctacaaatgccggaacggttgtacgtcctgtgtattcttcatccgcattgtagtaaagctcacttaagaactgtgcgcccgtttccggattgatatgatccggggaatttacaaattcccatccaagattctcttcccggtctgtccagtctacgatctcaactttcactgcatcctcaagtccgagaagctctcttgcgatcgctgcccgattggaccagttgcatccttttgcccagaaaagaatatatctgtctttttctaccggatttttcccttctccaaaaccttccgtgaagcggtttgactgacgatggaaatttccatattcatcaatttcctgtgcggtttctctcggtcttactctgatctgtcttccatttacatctacatattcaaaatctgccataattcgttcctcctactgttcttctgccttaaatttattgcccggatcgctgcttaaatgtgcacggtcatgcggtgcaccccagtatgcatcaaaattgatctcatccagaaatcttgcattgaaagattcaaaaaataatgcgccgaccttcttgttgtttggatttgcgaaatccttaaagtaggtgttgtttctgaatgccggaatctgatacaggtctcttgcatatccccacagattcggataatcgatcaggcggtgtttggtatgtccaagctgccatgtgtaacgaatatccagtctcgccagcgtcacatacagtctcacatcactgtctgtcacataatctccaaagagaaatctctgattttccagacgtttttccagaatatccattgctgcataaaaagaattataggcatcccagtaagcttcctttgatcttgcaaaggttgctttataaactccattattaatgttatcaaagagccagtcattcatctcatcgatatcttttctgagttcttccggataaagatccggtgctccttttttgtggaacggtttaaaatctacttcaaaataattggtaagccaggtgtaatcgttatttacaacttttcctgtctttgtatcgatcagagccggtaccgttgttcttcctgtgtaatcatcatctgctttataataagcttcacttaagaactggattccaaggaccggatcgatatgatctttgtcgtatacgaattcccatccaagattcttctcatgctttgcatgatcaaccatgttgacactgattgcatcttccagtccaagaagttctcttacgatcgaagctctgttagaccagtggcaaagctttgcccataccagatggtatctgcctttttctaccggattttttccttctccaaatccttctgtaaaatgatttggctggcggacaaaatatccattctcatctatctccgatacaacttcctgcggacgtacacggatctttcttccatttactacttcataatcaaattctgccattatttcttcctccgttcatatttatcagtactggttattttgtataacctttatttcctatcaatttagttggtataatatcatctattacctactaagtcaataggttattttatttttttgtttttttcttgaaacacatataaccctacggtataataggtaaaaaagcaccagggttcctaaactctctggtgctgctattgtacatataaaaaaatgggggaaaactaattatgatttctacaaaaggacgttacgcactccgcgtgatgattgatctcgcccagcataaggacgaagaatatgttccgcttaacgagatcgcaatccgccaggaaatttccgaaaaatacctggaaattgtcctgaaaattcttgtaaagaagaaactcttaaaaggacgccgtggcaaagggggcggataccagcttaccagggaaccttctgaatacactatcggcgagattcttgaacttgcggaaggcaatcttgctacagtcgcctgcctggttccaggtgccgaggtctgcagccgtgaagagcagtgcattacactccctttgtggaagaaatttgatggaatggtacatgatttcttctacgagattacattggaagatgtgttaaacggaaatatttaaggagattttttatgaatacttcgaattttgaatggccagttgataaaaagccactgtattccctgctttcaatccgcctccgcggtctgattgacggaatccctcaccagatctcaaatctggcaaatgcatcggcccttctcggtgatgcgcttctgaatatcaactgggttggtttttatctgatgagagaaggcaagctcgtccttggtcctttccagggcaaacctgcctgtattgaaattgaaatcggtaaaggtgtctgcggaaccgctgtggcaaacgatcaggttatgctggtaaaggatgtccaccagttcccgggacatatcgcctgcgacagcgcctctaattccgagatcgtaattccgcttcataaaggaaatgaaatcgttggcgttctggatatcgacagccctgttctcgcccgttttgatgaagaagatcaggaagggctggaacactttgtcagaatcctggaatctatttttgacagataagctgttcttccagatagcttacgatcacctcagctgcatatccatgtgacttttcccccggatgccggagagaacccacttttttctccggcgtatccgggagttctaaaaatccataaatcttttcatagcgtgatggcacattatgatccggattattatcacatcctgacaaaactccccatcctctctgcgaaacagcccggaattctactattttccacacttgacattttccttttctgcttatacattattacattagcaaaactatttttatttggagagattaagatgaatgaattattaaaaaagatccgcctaaaagatgcttccgcatttacacatagtggaaaattccacgcagatgatgtattttcctctgcattgttattatatttaaatccggaaattacaatccttcgtggtaataaagtacccgaagactttgacggcatcatattcgacattgggcgcggcagatatgaccatcaccagaaagacagccgcatccgtgaaaatggcatcccttacgcggcattcggccttctctgggaagaacttggtaccgaaatcctgggggaagagcttgctgctaagtttgacgaagcttttgtccagccactggataataatgataataccggtgaaaaaaacgaactggcttcactgatcggaagcttcaacccttcctgggacgaagatggcggaaccgatgaagcctttttccgtgcagtcagtgttgccggaatgatccttgacaataaatttgcccgttaccttggaaatgaacgtgctgacaagcggatcgaagaaattctcgaaacacaaaatcctgaagctgattcccgtattctggtccttcctgaattcattccgtgccagaaacgtctttccgaaacagacatcgctttcgttattttcccatccaaccgcggtggttactgtatccagcctcagaaaaaagaatattccctgaattataaatgcagttttccatccgaatggctcggtctggaaaatgaagaactccagaaagaaaccggtctttcgagtgcttctttctgtcacaagggcggctttttgatgactacagatactttagaagatgcacgaaaagcatgtcagatcagtctggatacctttactgacgagattacccttgtaaatctcagttccgacacttctacagacacacttttaatgaagctgccagaactcacgcatgtaaaaattatccacaaacctctgcctgatctccctgctttagatatcaatggaatttatgctgaggtagaaatgggaaaaacagagtggaaaaaatatatcaaagatctggtaaaagatctgctgaaaacgaaaccggaagctgtctatgtcgatggagatatgttttctctttacccggtcgtgcatcagcttcgcaaaaagcatatcccggttcttacttctgttacaaaagacggtgaaaaacttattatccgtatcccatccggttcctgattttttattatcaggaatttgatgatctgaaagtgtcaaaaagaatgtgccataacacattctttttgacaaatgagagcttaattatcccagtataattttcgctttttatcatccagtccatccacaaaccttcttttaaatacaaggaattcttccagatccatcaggatatggtatagcatcgcacggctctcaaattcctctctggtctttggaagtgaattgttcctgataatcgcaaaaagttcatgtagttcatccaactgagctgacggaactgtatgttccttcacacataccagcatatcaaacacataactcgaaatgatcattgcctcatctggcatatgtctgattttcttcatctcataatgtaagttatggatcacgttgcactgcttcatacgcatttcaaaataatcgatatagtatcccggatgtgagtgaaacgtattatcctgatattcataggcatcctggataaagccctgaacctctttttccaacgcacagatatcatcccatacatttctctgcatttccttattcgccagatatgccgagatctctccaagtatcatctgcagacgttcttccgtatatcgcatattttcgaccaacgccttgcgctgacttccataatcataaaacaagttcaggaccagtgccatcgtaattccgatcaataccagcataaattcatttgcaataaaatcaacttcaaaatctctgacttccagaaaatgcattccgatcagtgcatttacagaaatcgtcgctccccatccgatcatctctgagacaataaccacaaaaaaaacataaataccatatgccatccattctgattctactgccgagaatataataagcgccataagtactgaaattataaatgttacaaccctcgctaccgataatttgacagttttccactttgtagtcaccatcgtaagaagtgcaacactccctgccgccagtgaatacttcagtccaaacagattggctatgtaaatcgccagactgcttcctatcgcaatttttagtgcctgcatcccgatctttttacttttcattgttcctcccgtgatctcatgcacatattcccatgaattctgtgcacttgattttatatccatatttatgataccgagaacaggataactatgtcaaatatttttttacttctatcctacctgctccactccaaaaataattttgaattgtattttcgattttttcattttcctgcagcttctccattattttcctgtgctaagcatcagtttctttgcaaacatcaatccatccttctgcatctgctgcatcatccagatcttcctgttgtttttgctgttgctttccatgcatgacaagtattttttcaataagctctggattatcttcaccatcaaccatacacatcataaatcatgagtactttttcgtttttcacatcataatagtattgtgtatcattagctgtgttccttttttcgtctgccactttgatgcatacacagtcatatataatgcattcggaaccgactgatcatagctgaaccatacacatccatgtcacgctcatattacaaatatccaaaataacccctgtaatcattattataccgattaacagactaataaaccacctttttttatctttactctcctataatggtctcataaatttagacactttttcggacagattataatgaatctgatatactaaaatcagtatgaaagaaagaatttttgaataatgcagccgttatattcgacgataagcgtgaagaaaatctcaaagaaaaactcgccgaagaacgaaaagaaaaagctgcatatactctgtattgggagagacaaaatcggacatgattttagaagttttttgaaattattttttgaagtgcaaaaagacataaaaaaagatgccaggatttctcctgacaccatagtgactgaaccaatattcatgagctttcattttaccatctccccttgtttatttaaatatgcaacttttgatgaaatatacaaacttgaagttagcgatttctttttccggtattctctgtcccacggatttcctcatgatagaaataatctacgatcaccggatgcccctgcgggactctgccataaggcatttcattatccacaaaggcacaatcatacttcttagccattttctcagcttttacttcaagtgcttcaaagtagctgcggttatgcttgttatagatctcgtcgtaaagtggtacaagatcaggatattttccggcgatataatccataattgtccttttgaaaccgcctcgaagattgagattttcgagccagaacagatcgcactgatcctttacccgctcaaaaattgcttcaaaatccgtgataccggggaataccggggatacgaaacagactgtacggatacctgctttatatacctgcttcatagcagcgatacggcgctcaatgctcgaagcagagtccatatcgttcttgaaattttcatctaatgtgttgatcgaccatgaaacggttacacgtccaagcttcttcagtagatcaatatcccgtaccacaagatccgactttgtgcagatcagaatatctgcgtcactgccgatcagctgctccagaagttttctggtattcccgaattgctcctcctgtggattgtagccatctgtcacagaaccgatgaccacccgctgtccggcatatttcttcggatttttaatttccggccaatgcttcacatcaaggaaagtgccccattcctccttgtgcccggtaaagcgcttcataaaagaagcatagcaatacttgcaggcatgtgtacagcccacatagggattgaccgagtaaccgcctaccggcagactagacttagtcatgatgttctttgtttccacctcacgaatgaggattccatttattacttctgccatgatttctgtacctctaacattttattaaattcttccggcatttcctgaatcatattttcatcccctatgatagggacaaggtcttctttcataaacaccggaatgccgatcttatgtgcctggtccgtcagagaccatgcccattccggcttccatccggaaagatcgctcatgccggtaagaagaaagttctgcggacgtttcttttccatcatcttgagcttacccggaaagaattcaggggcagcgaagtcatcaatcatatgccagcgtttcacgttgttgcgggcatagcaatatgcacaccccactgtgcatccaatgacaatattcatgttctgaatctgatctttgatacaaatactcatgacttctgccactcctcaagattctttctgatgcggtcgaggcattcctcaaaccgggtaatttcttcctttgaaaaacctttgtagtaaatactgcccatctcatcagatacagaatcgtactcgccctttaaggcatgtgctttctcagtcagaaacaggagtgttttccttttgtccgtttcagactgaacacggcttatcagcccttgattttccattctttccagcatcgtagtaagagatgttatcgctaatccgcatttagtcgagagtgacctgattgagataccatcctcctgccacagcacataaagaatacgcccctgggctccattaaacgcatcaatattcttttcactgagaatcttctcgaaaatccggtctccaagctgttttattttggttacaagaaatcctccattcatttccatacaaaagctcctatatagtagtttattaaaaacatactatataggagctttattgtcaacagtttatatgtcctaataggtaaattccgttttttttaattctccaaactggaattgttaattagaattgctctcaaagcaacaattatcttaacattccccaaatacactccagtaatgttagtgcaaggataatgttaataacacggaaatgccgcagataaaacttctgaatcagtacgcccaagccaatccaggtacaggttgcgatcgttccgattgttgcaataaccagctcaaaaaacagcaaagccaaaaaagaggacatatatcctacaacataacccgttagtgcggtaactccgaacatatagatcttcacattgacaaattgcaacatgaagcctttcagaaacaatgccgactgctctgcgttttctgttgacggcttgctgaaaacaatatgaatcgcaagccacaggatataggctgctccgatgtacttcatcacttccattacatttggaagcaaagaattaaccccatatacaaaaattgcgcataagatttgtactacatagtagcctgcaaaaattccaaagaacagcgactttccttttttatatccatagtttgttacggtatttaatgccagaatatttcccggtcccggagtaaaggcatttataacgcaataaatcagaaaattgctcagtaccgccataggcataatcatcaaccacctttctgctgttattatatcagcaaacagcggtacatacataacacctattttatatgattatccatagcctatgcctatggattggctggagcatatttccgtaattcttccagatagctttttccaagttcacttaattcctgattttcattcaacacatatccaatatgcattgtttcattttctgcaagcggaacggagatgatattttctccgttcaaatatttcgggaaaatgccacttgaaatagtataggcattcagtccgagcatgaagttgacaatagcccctctgtcattgacccgaatttccttatccaccgggatggagctgaatagttcctctgaaaaatagacagattcatactctccctgtacaaagtttagccgcggataaagtgcaaggtcatggacggaaactacttttttcgatgccaatgggtgatctttttgcaaaaaaacattaggatttgctgaaaacagctcggtaaacaccagatggttttcctctatcactttccgcataacaatttcgttttcatgcgataaataaaggatgcctaaatcacagacacgatttttcacatcatccaatatctgatgtgttccggtttcattataataaaaagcgtatcgttcttgtccaaaacgcttaactaactccacaaaagcgttttccgtaaaagtatagtgctgagaagatactccaaatgtcacttttcctggaagatttgtaacataccgatcctccagcagttccatctgctgtatcacctgacgagcataaccgagaaattcagcaccatcttttgtcagagtaattccggttctactgcggagaaaaatggtgataccagcctctttttccgtttctttgatggaattggacagacttggctgtgatataaaaagcagttttgccgcttcggtaatagagccaacttctgctaccttcaaaatatattttaaatgttgaaccgtcatttcttcatcctttttattcttccgacttcccgatttatctcatagtaccattatcagcgtacctgcaccgatcagtacaattcatataatcagcataaacgtaaagctcatgctgttaagctttcgatcttgatttggctgtgaactctgagataacaactttgatgacctctactgtcgatgccatctcttcattgatattgaattcacgacccgtctgatttttcataaagagcgaaagacctcgtattttctcctgcacatcctctgttaattctgcacgaccacgcccaatcacagatgcaaatgatgctccgtatttgcaagctacatctctgccggatataagctcaacatcactttctacctcaatgcacacatttggattacttctgatcagatccagcttatgcccttcttttgcgcagtgcatgtagaaaatcaagatgccctctgtatattcgtatccgtagtgaagtggaacgatgtagggataatcagcatcaaacaaagcaagatgcaggactttcgctttttcaataatctgcagaatttcaataatatttgttacttctcgatcttttcttctcatagataaatacctaaagaatcgtgcacgattcctcctttttcaaattttaaaattatacaatctggaagttgtgtttatttgttttttctcaaattcgtagtagataaaagcaaaaaacatacacacttgattttctctttttccatgatttttccacctccataaatcccgattgagatttcacctgttttagggaatttaataactgttatattttgttattaaattctctgcaaacccttgaaaacactggatttatcgcaggtgagctttcccttattgtttcccttgtgttatatcgtcccgtcagcgtttacgaactctgataagggcaaatacaagggcaagaaaaatctataaaacagtataacacaaaataaaagtgacatggtgaactgattgaaatgcttctgatttttgtaacaaatgactgattgaatgataaggagattctatacgatgagaacaatatttgcagaatacaatccacacagaaacagcattgatatttatacttctgctggttatatgctccgcattgactgttgggaagccgaaaaggatttaaaaaccacacccggatcagactgtgcattgaacgcacttgccattgataaaccgcttgaatatgcaaaattatatcttgatgaaacaatgcagatatgggtagatgcagaagattcattagaactatggtgattttttcaacagcactaaggttactttttcccaatctcatttattgagaatcgtctttttaccgtgcatatatattcaatatctttttatctattataatgaaatcaagggctggtctaatgccagccctacaaaaatgaaaattcacatagaaaataaatttacaatttttccgatataaacctgttatcaacaaatacaaacataatttatattatcgtatctattgatatgatatgtatttcaaagagttaccagaagtttttgaaaacttttcccttgtgatattatctaaagctcattcctttagataactataaaacaacgaagcccgttagcccttgtggttagcgggttttcgctgttctgtacttgttgcaaaatccgcttcggtcaaatctcggtcaaataattttctaaagaaatgttgcaccttttctattctctttcttattcttgttctgattatatgatttccttatacaaattctgtaatttatccatttccgattttgctttatcatctgtgacgtgcgtatacaaatccagtgtgattgctatggaataatgtccgaggaatccttgtactacctttgcgtcaatcccggcttcaaaacaacgcgttgcaaaagtatgacgaagtgcatgtggataaaaatgcggaatcggtataaacactgtcttgtttttctctgcctgcttttttcgttccttattgatagatttttctatccagtctaacgtcacttgaaaggtgtgttctgtaatcggttttccgttctttccaacaaacacaagattttcaaatccctctaatggttgccattcactagctgacaactgcatttctttcaactgaatccactgacgttttaaagccttatacacactgtcctgcatgggaatcgtccgtatactgttctttgtctttggtgtctggtacttgaatacatacttctttgtttccttatctttgatatacaccaacgttttatttacagaaatttcccgtttccgaaaatctacatcatcccatgtaagcccaagcagttctccgccacgcattcccgttccgagtgctacctgtatgagattctcgtgtattctctcctttgcgtgttccaatacttcccgttgttctttcacagtcagtacccgtatctgttttgtctttgttttgggaacttccactcctgcacatgggttgaatgtaagaatcctgttatgcactgcatatttgaacatagcattgagaatattatacacatcccgtatagtctttgtgctgtaatcatcatctgccatattctgaagcagacgttccaaaataatcggattaaaatctgccacacgttgttttcctatctgcttctttatgtaacgtctgtaaaaatcatcataacgtacttgtgtactctccttgatagtccgcttcttatgggtattcagccagatatcaaaccatgtatccagagtgatattatcgccctttcctttcaacccatgcttgacttcatagcgtaaatcttccatttcttgaactaacttttttaagtccgcattatcttttgtatacgtttctcctttgtaataaaaccgccctctgtaaattccgctttttctctgcataattcccggcggtaatggatttccttttaagtccttgcccaatctgcacgctcctttccgtgcaaggactatcagaactggtctgacagtattatatgcttatttgtgtttatactgcaattacttcatatttatttttcagattatgcccttcgtttttcttcaaaaactggtctaaaacctcagagagtataagaatcttatttccaatccttatgaccggaatcttctgccatgtaatcagctttcgcagattatttcttccaattcccgtatactctgacgcttcattcactgtaagggctttctttgtctgtatcgtgttctgtgtatgttctgtcaaagattctcctttcttcttccctcaaaaggaaagattttttatagtcctcatatatgcgttgttgttcttcgttcatctgcccccgttctattagctggcggatataatctctgttatccagttttccgattttatccattagctttaaagagggcgaaactgctacgttcagccactgccatgttcgttccagtgtctttttctctggattcatggtcaactttatcttccctacatcctgcatgagttcttcccacgggggataagtaggataaagccgttttcttgtaaccgtgctgttttccggcttctgtaaaaaccgcactttctcgtttaatacagacaacgcaatccgtgccacatccctgtctttcagaagttcttctactaatctgaccgcttttttgtgccggaatcgaagttcatatctgttccagtccgggttgagttcttttccgaacttttctgcctgttcatatcccttttcatagaatgtaatccgaaaatcactgtgtttactgccgagatatagtgtttttccctgcgcttctatttcatcctctttcagtctatcagaacgattctctgctgtatcacgcaactgactagatatcagcccctcgtttttcagacgaatcaattccgggatagacagataaggctttgtatcgtcgattgccaagtctatcctcggaaaattcaccgggtatctgcaaactctttccagaaaatcaaaccatgtttccttattcatcataaggaaattttcataattcctgcaccccgaaccactcataagaatctgaaatccctcatactgtgcatttcctgtcggtttcagaatcttgatattgtcaaatcttgctatcagttcgtgtccagcaattcctttttccttaccatgcagttccataaaactcagtggaatccgcaagatatcttctatgattatgaacacgtctacacctttgacagtaatctgacaccagtcaatcagtgctgtcaaatcttctttctgacgagttacccccctgttagtataggggggttctgaaattttcattacctctgttatcatcatccctgcctttcgtagtatgccgtggctttcgccacgttcccggaacttcctctactccctttgctcctttcacgctgtacggagcagtccgcagagaatttccgggaacagtctctacacgtttccttttccggtaacaacacggatacccttgcaggagattctgtccaccaataccgggaagtttcctctctgcacataaggggcatataccgcttcttctagttctaccactgtgtaaggctctacctttggaagttctgttgcttccagacggatatctacgctgtttccaagtttcatgcttccgaggtgaagtttcaatgcttccacttcctcggttttcttccgggtttccttatcatacttgtagcagtagtctgctcccatgtaacggagttccccgaacgcttctctgacctgttcttttgtcaatgtaatctgcatgctacatttctccttttttgaaatcatggtgaatgagtgtctggtaagtgtgacaagtccttttcatatccacgtctatatttatttcattacttttctccttacctcttaacctcatcatagacctgttttttcttcttgtcaacaattattttactttttcccttactttttatttttgtatttcaaacgcttaactatatctttttataacttattataattttacccttacatttatccttatcttgtgttatgatgaaaacagaaacgaggtgtgcatatgtttgtgaataaagaagcagtaggaaaacgaattttacagatacgcaagaaatacggttacagtatgcagaagtttggggaaatcatagataatgccccgaaaggctctgtaaacagttgggaaaagggtgtgaatcttcccaatgagaaacgcttgaagcagattgccacgttgggcaatatgacgctgaatgaacttctgtatggttcatttaaagaatatgtagatatgcttatcacagaaaaactggggattgaactgccggaagaatttaccagaactttctattctcttttagagcagaacggatttacctacggggatgatatcgagattgtccggcttgtaaacggctttctgacttatcataaccttacaacaaaagaaaccgccattttctatcagccaactgcatactccggcgattattttgacggtatcatacaaaaagcggattcttccgttctggtctgccgggcatatgcagataaggcaaacaacaccttacatatcattccggcttttgagaatggacagactgaggaagtagcagacttctttcatgcactgaaaagcataaccgctccacacaacaacaattatttcacttccggctttctgacactcggactggcattgagagattccaaagtaattatctatggaattgatgaaaaacagggaacaacacaggtaatcccttacgaatatgattgcgaatcagacgcttatatccagaatgaacatctggcatataccagacaggatagctttttccgagaagccacgaaagaagcggtctatcggaaaatgcaatccgacagaagtaacccataagataaacaagaggacttgcaaggtttgtgacctttcaagtcctcttatgtatcatgatggtattggctgtgtccgttccgtaaaggactgccctacggcgtctcggcttcgccttgttcctttacctcactaataataatgttctgatagcagaactcttacttatacttttatcttactattctttcaatttttaccgtttcaccatcaatattatacttaaaaaaataaaatttaataacatttccttctgatacttgttctagatcacctttacacttagtacaatctaaactaacttttgtcgtatcaaaaaatagactactttcttccttctcatttagttctattaaaagtgtatcaaaagttttctctacaacaaccccactcaaatgaaaccaatgagaattatcatctccactagaacgcaactccatattttgacgattctccttaaaaacatttccttttacgccaagcacaattaatactattgcaagcaaaagtatgattaacaaaatcaatcgtttcttatccattaaatgtagtccccgatatgtctgtccaactatcaaaatcaaaattcaaataacgtactgtatccccccatccatcaaataccatcaatgtatgtactgtatttccagaattatatgctcgcaaagttgcatatccctctgctgccattgaatgccccgcacgttctccagtatcactgctaattataccacaatggacaactgctatatctcctctatcaatgcaattagtgaaaaaattataattgggactatagtcagtattttgtgttacagaaacattctttccagcacaaaagtccacaaatccaggtccaatattgccaatagttgttgaaccatatgttattcctccactctccgatgaaactgtcgttcctgttgaatcccaaatatccatataatcacctgcaatatctgtataatcaacagcattataatatgcaccacatgctaataatgcactaactgcacatgcataatgtcctgttacactttctatatacggctcattaaaggaaataaattcttgaagatgatttgttgaaacaagcgtgtagttttcataaacttcatcaatatctagcaaaacctcatcccaagtagctgggtcttttcccctactctcattcaaggacagtactgttttttctaatgtttcaccataattcgttctaatctttcccaaattatcaacaataccatattcaaacggagctattttatatatttcagaggtatttgctttttcactaaatacatttgcttcactttgataaatcacctcatatggatttgctgaattattaccaaatgagtattctgatatcaaagattcacacgtagtatcaaaaactacatatccatatggtttgttttctaaattgtaatttacaatatatccaatagcttgacctgttgtatcataaaattttctcggattattagcaacaatattgctattttctcctattccctttgcaaaacgttctgccatctgtatcgccaaatcatccgtaacatttacaacagaagtattctccgatgcatggacaggaactattgacataatagtcaatataaagattgtcaaaagtgaagcaaatcgtttaaaaatttttctcataaatatccttcctccttagattatatatttactttaatattatatcttattccctattttgtctatattttttatgtttatttcaaatatttcattctattttatttttatcaaactattttcaaacaaatccaaacaaagaatctcggggcaaatttcggtcaaatcaggataaataaatataacactttatatgtaagtcaattttaaaaaagcctgtaattccgggctttacaacactttgtaacacaatataaaccagttcgataatccctcctaattttatacttttcccatgatggagcagcttatttgaccgtatctctagcaccaaagatgttgtattctatactgatacatcaatagaattgcgaactaacctattaccatttttgacaagcgtagattccactgattctcttgtaacgttatcaagaatgcttgtatcaaacttttgtcccggcttccaatttggattagccgatttcactgctgcatacatagcagctctatactgtccttcgtattgctctaaagtccatgtaccacttaaacgtttgtctttacttacgcttaactgataatccttaaaaatatctgaacgcttagttgtatcaccatttgaaagaccgttttcctgaataaattccctcttcacattatcaaacatcttttgacgatattcctcagatacacttgtgagttgctgccacgatgtacctttgccggtaacatccattcctgccactccatttgcattcagcaaatcaccttctgaatcaaattgcttcatcagattattaataatggtatctcttccaccgaatgtttcatatatcattctttcttctgatgacatcatggcttcattttgcataatacctgataaccagcccttttctttcaaagccttatattgtttactatttgtgttgatgccattataggtattgcctaatccgctgatattcattgacatataaaacctccgtgtaaatacattctaaatccgtttgaattaactctatgctatatagtatagatcgtcataaatctccaaaaaataaaggaacccactttattaagtatttttgtttttagcatatttctaaagcacagaataccattgtctgttcatacgatcagcttcatactggtatgtaatcaactggttcatatcctttaagctgctctttccatatataatgcttaaagtcatatctggcacattgttccatcctctggttgaaatagttgaaaccaggtcatgtatccaattattcatttgctgcttaaactctttcggaacttttccggaactttcaactgcactatccactaagtctaatatattctctcccgactccgtataatatgtcccatttttttcctcaagtttgtctaattcatatcctgtataactataaacctgatgatatgcttcgtatttcatctttgattcctctgttacttgagaactctcacagccatcttgtgttgagcaataatagatatgcttatagagatttttcccattattacctacatttaaagcattctgcatcaacacctttgtttcttcatccacaccatctaccgttatctcgtaactgtatggatcgacagtaaaagtacactcttccttaatagaagatgtatctacaccagcctgctttaaaatatttgaaatctgtgaatttaccaatgctctttcaaattggattttatccgaatctacactgtcgccgtctacttcaattcccctgaacaaagaatcctgataatttacaccatttatttttcctgtccggcacatctgcatctcataattatatgcaatcctacgttctgtatcagtcaaattagtctcgtaatactctgaactcttatcaaaatacttggaatgaatataattttctgggttagaatgtgtttttgcttctgcggcaagcttagaatacttttccgttaatgccgccctaaatgctttacctgtactcatatattcacttgttttcgcattaatctgtgttcctgcattctcaatgagctcttgattcgttttttttgctgaagctatataggactttaagtcaatgctgctgtcaatacttgtgttatgtgttcttccacttgtactttttgtcagtttttcctttcccgatgcacttatcgttaaagtatctcttgtgcctctacaaccagtgttttgactgcttgccgctttttgttgttgaccaaacagaacattaagcaacgactgattagcattaattcggctgttaaaaaatatattcataatatcaccaaccttcttattatatatcggattatcctaaccttgtttgtaatcttttctttcttcaaaattatagaaattgatactatgcatatgtatcaaaacctaccttatttttagttgtcgcttctatagcaatcatattttctgtttttttatcttctttttctttatcctctttcattctctccagccatttgtcaatttctgaatccgtaccagtctctccaaaaatgccacaggttgtcatttcggttccattattcgtaaacttaaactccactgatatcagtttactaccatgacttattgccgccttctgtgcatttcgtataacatctggcataattgctaaattttcctcaagccatttcgcagttttttcatctccacatgcctttctcattacacttccgtcaatcaatacagaagcatttttgcatgtaattaaaaaaattacaaatcttatgcaaacatacaatatctacctaaattatcaactttatatgcattattttcctgagtggtgccataattatcgccataatatatctttattcctttcaaaatttttgtccatgcacttatgtctgcacaatcattttctgccgccaaacattttctggcagtagcataacaggaacccggcatatcaatttcccatgctttgctggaatcaccatcatacggaatatatgtaactccattaggagtcaaaaatgtaaaaccatctttttcgcgtttcagatttcctgatatctcaagtaaagcatataatcctgccgtagaccgctgtgaacttaccggatatttttgaaattcatcagctaatttattcagcgtctctatatctttatcggatgttatgattaccgaaactccttgtgcctcatttccctttatcgacaaataatttaaccctgtctttgaatcacggtttactaccaatcccccctgtagcggtatttcctttatatcaatatttcttttgtcagacaaatcattcaaaagatttttcagttcacttgtcatggttacattatacgaaaatggctgatccatattaatcaggaactccattcctgttttctcatctctttgaattgctaattgatcttctcttatataaaaatcttttcctgcctgcttatctacaatctcatatgctgctactccatttacatatgtagcatcttcgattttatatctttctgtttctattggtaattcaacatcttgagatatgctattttttgtataaattccaaagttattataatccataccattcacataggaatcccttgtgctaaccttattacttatactctctctgactttattcattgcatcagaaaaatttcctactgcatttctattatttttttgaccacacaacctgtcttgttttaagtaaccactctctattctcattattttacctctcaatttcattattcttcttaaaagagggaaggaaaatctatacctattccttcctcttaaaacaagactgctccaaagcactattcaagatttacaccatgcctaaatctcaatttcccgctttataccatacttcacattttgtgttgttccaactgcatacccacttacagtaacagtccaagtgcctgatccgatatcatcagcagtataaatccatgtatctgtcgaataattagcgagctgcttcgttactacattcaatccgcttctgaatgttatcgtaccctgatacaaatccaaattattgtttttaggtaaatacacatacagctttgaattgttgattaacgtaacacttccaagtgaaacagtaccaccgtttcggtaaattgttcctgcatatttagcatcagacggcacacttgcaaccattatttcttcagtttcagatgctgccggttctgctgccattaccggaatggtaaatacattgagtattgtcaaacaagacaacaccattgctaaaatactttttttgagtctcatattgcttcttcttctaatattttataaacaaaattattgttcatccaataatttgatttcagtctttgttttcttccctaatttcatatggaactcctcctttcttcaaaattatagaaattgatactatgcatatgtatcaaaacctaccttatttttagttgtcgcttctatagcaatcatattttctgtttttttatcttctttttctttatcctctttcattctctccagccatttgtcaatttctgaatccgtaccagtctctccaaaaatgccacaggttgtcatttcggttccattattcgtaaacttaaactccactgatatcagtttactaccatgacttattgccgccttctgtgcatttcgtataacatctggcataattgctaaattttcctcaagccatttcgcagttttttcatctccacatgccttttgcattacacttctgtcaatcaatacagaagcatttttgcatggagtcaaacatttatacttgttagtcaaatactttgaatagtctgatacatttttaaacttattggctgaattcatagtgtatcctgcataataattcttttcactattctttgatggctttacattttcattttttacatttccgtatgtgtatgtattggcatacgatgatactccattaattcccatactgtatctctcctttctatttagccttgattttttatttgcaggctattgggttttgttcgatacgcttactgccattgtaaaatttgtctcataagaagctactgcctgacttattgtgacagtcttagcagacgaactactctcagccaccaatcgagttctggcatcctgagcggataaccttttattttgcgcatattcttcataagctgttctttccgcttgttttttctgaatccgctttttttcctgttgtttctttacctgattttctattctctttttattttctattctgcgctcccaaaaactattttttgacttatcattaaaaatcttcccaccattcccattgttataaccagcactccacatctcagcatgacattcttcttttgatgctccataatatattgtagaaaacgctcctccgcatataccggaccatttatctggttgtgaccaacccacttgcaaatcatttaatacccatgcttcatactctggatcattcttcattgcttcaaaacccgcctctgaaattgtaacagatattgactcgcctgctcttgtggggtgcattggaatttgagatattttattgtaaatgtactgcttgtattccaccatcgtcatatctttagcagacacagaacctatttttgaattgcccactatacttccactagcttcgctcttttctcttacactatccgcaaaccttgtatcttccttctcctgatctttagccgcatttttctgttggtactgattgtaagcccgtgtcatatagttcacattaattgtattactcatagtaacctcctttgcttcctttatcggataaaataacctgttctcctagtcccatatcatcaaacgaccatattgcgcacaaagaccatatttttacaagatgaccactgccttagtagaagctctgtatctcaaactctttgaaatacaatgcttccctgcattttctatatcggcatgttgatattattactttactatcctgcacactctctgagagtgactgtatctatcaaaaaagaagccagcagtttattcacgcactgctgacttcttataatactactcattttatttacttcgctgcgtctcagacaatttttttatttttaaacataacctctgttttcccgccatccctttacataccacctgattccaacatataccagttgcacgaataataagagaaatagcagattgattggcaatacttcctttatccaatccccaaagtagatagctattgccatacttacaagtatcaccattatggtaatcatatcccaacagtatttcttatatagccctgcaatctttatttcgatgaatgccaaaagtattcccacacccaccagacatccaccgcaaatcaatattcttatcagccagtttataattccagcaacgacaggattggatattccatcactaatctgtgccacgttctttcctgccagtacaacccagccagcaatggtctgtgtgaaagttgcgattgtatcaaagaataccacgcaatcagaaataaatatttttgaccgtatcatctgaaaaagagtagttgatacggaataccatatcagcagaaacatcaatgcttcatacatggctgtttttgttttatatctgcctgccagtttttccctctgcatatcatacttttccttagctttcagataagctgtctgtttacaattcccgcacttttgatagagtaccggcttttcaaccggtatctctacttttttctgatgggagagtgcataatcccgttcctgttctgcctgtctctgcttatctcgacattcctctatcatggcttggacggtgtgtgttttctctttctcgctctgcaacaattcttttgttttcctcaagtcgttctttaaggcttgaatgttctctgttttgttctcgctgtttaacttctcgttcaaggtcagcgattcgtcgagctgcactttcagttccctgatagtccggtctttctggtcgagttcttcctgcatctgctctgtcagcagaagcaactcttccagttgatcgtcgctctttgagtttcttaattcgttcatcaatcaaccttcctttctctaattgctgttcaagttcagtaattcgctgttctgtttctgcaatagccggttctcgctgtttaatttctgtgccaattcctgccattgctgattttcgtctgtgagtttctgtatctggtctgtcttttcttccagaagcatcaacagttcttctgtatccggtaagatttgtagcagctctgacaattctttctctaattgctgcaatcgttcttcctgctcctgaaagcacatcagcttctcgtccttttcctgtatctcctgaagcatctctgccatgatattctgctgttcctctatctgtgtaatcattgcttccatcatgggaattacttctttgctttcttctaatgtcattcaaccactccctccacatcgacaatgcaccggataccttaccaaaggttgcaattaccttttgcagcagtgcattttgtttttttatcatctggttttcctcgaccttccatgaacctttccttatctgcccggtgagatatttttcctcaatcttccttgcatctgcaccctcatgaatcgtagggactttcaatttgccctgtctttcataagagcggtggtcaatcagattgtctatggataaatgccggttacacatctttgcccattcgcttcgccataactcacaattctttggattgttccagccggtagcgtcagtcagaacccttttccattgttttctgtttcttgccccgactttctgtactccgttttcatcaagtaccggaatacggattccatgacggtctggatttttcttatcctgccaccagtccgggtgggattcatcaaccacgatatttccgtcagtatctctgacaaaatcccagtccttgacttccttgctgccccatgagtggtctggattgaatggtcgcatggttacaagtaaatgcacatgtgggttcccgtcgcccttatcgtgtatgctccagtcggcacacattccctcgtccacgaaagtcttttgaatatattcggttgtataatcaatctgttcctgtctgctccattctttcggcagggaaaattcaaatgagcgtccaagctgtgcatctgcatttttttctatcttcaatacctcattccatagacgctgtttctgaaatgtgattttaaacttttccagtgcggcatctttatcatccgctcttttataacggatagactgttgacacctttttatattttcttccggtacatgcagccattcaggaggtgcattttcgcacatcatcagactggtgtagacgacttcctttttggaagtatagtaactgattctgcctgtttcctcattcttcatcacatctccattaagatatgccgatgcggatatgacagattttcctttactgcgcccgacaatctttactgtaaagtgaaatatcgccatgatacgattccccctttctgccgtatccggcattgatttccgacagcatcttcttctggtttggcagaagtgaagctgtcggaacgccctctgcgcaagagtgccccctgcggcatgagcaggtctggctgaaagccccgccgacggaacgagcccggcaagcgtaagcgcagaccggttgccacttgtggcaaacttataaggacgacctctggttgtccataagtgcgcccttcattcaaaggcaatgaagggaatggaaaaaccactccctccgccattacacttcctccatatctgtaagtggctctttctgcatcgcctttgagaaaaactttccgtttgtttcctgcctttttaagaagcctatcaactttggtaaatcttcctcctcaatcggacagccaagaaccgattccaccgcaccgccaatctgacagagcctgtgggttcgttttttactttcctcggctttctttctcttttccagttcctttcgctgtgcaatgagctttttggtagcttcgatgctttcctgttcctttttctctaatgcacgtattctttcttcataagtctttgttgatttcgccatatcgtcttcatcctttctcttataatcaaatcttgctctgctaagatttggcacacgattctggtcagctctgttgacataattccaatcagaatcgtggtgcatccttgcggagcattatcttgtcgatgtttttccgacaagataaacattagttcccggttgcatatcaggagaagcacatggtataatcctcttgcgtgtaggtatatcatggcttcggtctgatagaacctttggcggtttcgtaggaagccgcctttttaagttgccacatttcttgtgacagtttttacatttcctttatccctcagatctcgcccctcgttggcttccatgaacttttccagaatgtcagttttaataaggacttttcttccgacttttaataccggaagtttcttccattcaaccagctttctcaaagtgtttctgccaattcctgtatagtcggctgcttcctcgatggataatgcaatctttctttccgtcatcttgtcacctccttatgaattgcattatgcaatttttgttgtgctgttagtatagcggttttatattgtgttgtcaagcgttatgaaattttaaaaataattattatattgcatattgcaattatgtgaggtacatgctataattcatacataccgaaaaaggaggcaatcagcatgaaagataaagaactacgcaagctgataggcagcagggcaaaacagcgtcgtctggaattaaatctgacacagccttatgttgcagagaagatgggagttaccgcttccacaatcctgcgttatgagaatggttcgattgacaataccaaaaagatggtgctggaaggtctttcggaagcacttcatgtatctattgaatggctcagaggggaaaccgatgaatacgaaaccgatattacggataagaaagaattacagattcgtgatgcaatgggcgatattctcaaacagttacctctcgaccttagtaaaaaggaagatgctttttccaaagatttactgctgttgatgttaaagcaatataacctgtttctggaatcattccagtttgcctgcaagaattacaagggcaacacgaatgaagctgatattgcaaaagtaatggggtttgaatcgaatgatgaatataacgagattatgtttctccgggagatcacccacactgttaatgcctttaacgacatggcagatatcgtaaggctttattccaagaaaccggaaatggcagaacaaaggcttgaaaatcttttatcagaagttttgtatgaggattccgattcggtatagaacgacaaccggagttatgatatacttacacgcaagaagcatttcatcagttccgattgtctgatatcgaaaggagacacacgattatggcaaaaggatctgtaagaaaaaaaggaaagaaatggtactaccgcttctatgtagaagatgcaagcggcaatctggttcagaaagaatacgctggaacagaaagtaaaagtgaaacggaaaaactgctccgtcaggcaatggatgattacgaaagcaagaaatttgtcgcaaagacagataatcttactgtaggagaacttcttgatatgtgggcggaagaagaactgaaagtcggaacactcagcaatggtacagtggaaaattatcttggtgcaatccgttgtatcaagaaacatccgattgcagaacgcaaattaaaaaccgttactgctgaacatttacaggcatttctcgatctgcttacattcggtggggaatttccagatggaaaagtgagaaaaggatacagtaaagattacatccattccttttcagcagtattacaacaggctttccggtttgcagtatttccaaaacagttgattacttttaatcctatgcagtatattaagctgaaaaaacaggcagaggatgtggatttattctcagatgatgaggtagaagaaggcatacagcctatttcccatgaagattatgagagactgatagaatacctcaaagtaaagaatccacctgcaatcctgccaatccagatcgcatactatgcgggacttcgtatcggtgaagtttgcggattgacatggcaggacatcaatcttgaagaacaatgcctgaccattaaaagaagtatccgctatgatggcacaaaacataaaaacatcatcggaccgaccaagcgaaagaaagtaaggattgttgattttggcgatactctgactgaaatactgaaaaccgccagaaaaaaacagcttaaaagccggatgcagtatggtgaactttaccaccgcaatttctacaaggaagcacaggacaaaaacagagtgtattatgaatattatcatctggacggaaccgaagaaatcccggtagattacaaggaaatctcctttgtctgcctgagaccggacggatgtctggaactgccaagcacactcagcattgcctgccgatcagttgcaaaaaggctggacggatttgagaatttccatttccaccagttgcgacacacctacacaagcaacctcctctcaaacggagctgccccaaaagatgtgcaggaactgttagggcactctgatgtcagtaccacaatgaatgtctacgcccactctacaagaaaggcaaagcggaactccgccagacttcttgataaagtggcaggcaacgactaaataaaaaattcccttatttcccttgctgattccgcataaggtcaaaaataagggaaaatacatatcatttcactatttaaggggctggaaagcccgtaaaataaggaaagttcaagaaatctctccacaaattccgatttcacgatatcatttctaatacagattttaccgtattttttagattcagtccatcttttaatcccaaccgatagaaaaacttttctgtatctgctccactgctgaaaattgcattacagtattccgtaatcacttcttcctgttctggggataacgtttccagtaattcctggtatttcttttcaatctcacttactggctctttaccaacacaatattcaccgctgcaagtaccagccaaacagaagctgcaataattcgaaatggcaattttatcaaaaatctcaacatatactgccggatattcttcactttgcttgtactcctgtcaagactgaaaaacacatactggatgtgttcatacccgactttcagcaaacggctcttgaccacttgtgtaggcacagcttccccgttgatctgctgatatggctttgtcgaacatattgcatccagcatcagctctaccagctcttctaccgtcccgattttgatacgataccgattgcatctgttgcttttatccattgctacggtgtcagcgtaaaagcattatcaccagattctgctttaaacctatcgaattcgataggtttaaaattggtcatctgccttgtactcaacaaaactttccggaagtgcaatgataaactcccgtccttcaatacacttcccagctgttccgcttgtattcagtgttatcgtatggattatggcatggaccaaaaaagcactcgataaaaaggaggggatcctgatgttgatcctctatgccatttatgttgtatatatctgtacacaataaatatgaaaattgattcactgatgtgataaaattctacctttatattggaaacaggaaacagaaaaatcgcttgccggcagataaatttctgccggcaagcgatttttattttttcaattaaaatcctgtcaatctgaaaaacatcaattcatttgctgatccgtcgtctcgttcctgtgtcagcataattaacagagagccgtcatctaaaagctgcatatcttccagccatggataactgacaccaaatatgtcctctgtagaaattgcacctacgtgcgttccatcttttgcccaaaattgtatttcacgcatatttccatctgcagccacaaaaccattttctgtttccgccatgcctgtaatggaaccgagcttgtccggagaactgatatcttctccacctaatttcaaaagctgattgccatcataatcatagacaacaatttttgtgccttcatcttccacagccatggagccggcaaccataatatgactattcgtgatctgtacgtcatctatcatagaaaacagtcccttgcgttcttcatctttatttaatccggtcagtatccacggttctgccgtcaggttaccgccttgattcgcaatcttctgagtatcactgttcacccagaaactgattccccattctccggatggatgcatattcagatctccgtctactgttgtctgaagtgccttttccccatcttttacgccaattacatctccaattccaggcgaaagatataacattccactgctgtccccagacaaatattcaaaatcatcgtctaattccatcgaagatacgaattcaagtccactttctgaatattcataagtatccagtttgttctccagcaaatggaacacttgattgccctgttttacaaactgatgatccataatctgcataactccctgtgcttctttaaatgggatatatttcggaacgattgtataagaacctaccatctgctctgccaatacaggttcaacaggctctccctcccatggccatggtgcgtctttatttccttcatcctctaatttcagcacaattccttctaacaattctttgtcagaatcatctatttcctgtcctcttactctgatatcataggatgtgccagactgttcataacgatacatatacgttttttctatggaattactttccggcattgctgtatattctgcatttcctattgttacagtgtccatttttccttcagcatatgcctctaaatccactccaaaggcaattaaactctttcgatatgtatatgaatcctccttggtcgcttctatagaaatgacattctcggatccatctactgtatctccatcaaaaaatctaacgtaagaatattcttcatctttcttcatattctctttatcgtagttccatgccttcggataatacactgtaaataaacttaatttaagactttctctgtctttaaattctgtttcttcctgctctgctttttccgattttttcttctccggattctttttttgtccacatgccgctatcatcatcatgcatatcatgatacacagcacacaccatagtttctttttcatggcgtcttccctcctttcatgatttccacatccttttcagttattcactgtcactttttacacagtggaatgtgtagtagtcatcatcatcactgtagtctactttcaaagtaccatcgtcatttatcatcactgtaagagatggattttctgattcaatcgaacaatatcccagtgcaactgaccatgggaaagtcccaatctcctcccctttataaataactgttacattacggtcacttttgaaatcaagacgcagtgcatcattgatgttgtctactccttccatagaagtctgaggtccgtctcctaaaagttcttccacgctttctgcagcccactcacctatgactgcattttcctcctctgtcagatagagtgccggatccattgcatccgttccatcctttgcaaaaatcacctttactcccatctcgagcatattatcaaaagaaataatatcttttccgatgattcccaccatctcttctccttcgatgctcaagataaactgattatcttcgacagaccattttccattcccggtagtgtctccaactgaaaaggaaacttttccgttgttttttacttcaaattcaaaagcacctccgaaagtttcatctatactgacagacattcccatcatctgagcggacaccgctacccattttccttcatacgggttcttctctcctgtttttccggagcctccacaaccaatcagcgctatcatactgataataagcaccagtccaaataacaaattcaacttctttctcataatcttctcccctttcaattacttcttatctgcaaaaaaaggagtcagcaattctgccaccttactgattggcattgtctgcaagatcacctttcccggtcctttcacaacggtattaaaaataccttctcctccaatcagcatattttttactccttttacagctacaacatccataatgcaggtttcttccattgccgctaagtaccccgtactgatcaaaatttcctgtcctgcactcaaatcatactccactgcatgtccatcaatttctacaaacgcggttccatttccgctcaatctctgcataatgaaaccttctcctccaaatatacctttccctaattttttctgaaaatgcatggacagttctacgccttcttctgaagcaaggaatgcactcttctgcacgatcatggagtgaccgttgctaatctccaatgctttgatcgctcccggaaaacttgatgcaaatgcaatcattccgtctgcaccttctgcggtatatctgttttgaaacgcagaatcaccagacatcagtctgccgaacattttcttcattccgcctccggaaatcgtctccattttcatgttcgggctcatccagctcatacttccgctttctgtgatcatagattctcctgctgataattcacatacaacaactggtaaatttcctcctaaaatctcatattttttcataacaaagttctcctttcttttttgttttcatcctacaacagtacctttttcattaagctttgtagcacattgcacacacatatccagatcatcacagattaaaaagcaatggtcacatacaagacgcttacatatcggacaaatattaaagatctctttcgcctgattcaatgctttttgaaatgctaaattcttttcccgttcataaagtgtatcataaataatcttccgattttcattttccggttttttccccgctctggaaaaacgaattggtgtacttttccatactgttttacattccatgcagcatagtgaaaagcaaaactcatccggcgtagaacaatctattaaattctttttcgtaatatattccacatttttaacctccttgttaacctctttgctctatcaccatcctattctctgttctccctccttacccattgcctttatttttttctctgatcgggcggccaccatttcgtaatgaaagcgtagcagatacgaaaagcaaatactatggtcgccattcgtatattatgcttatttttcaaaatacgaacgattagtatactatatatagcgttttatttttacatctccgctatatatgcgcaatatctttttgtgaaaatataaaagagatctatcggcaaacaaaaaaaagaccctagcatcatttctgatgctaagatcttgattggtcatcttaacttaatgacattgctgtacagactctttttcttttactcagttctattatatgtcagcttatctaactgatcgcattttcgaaacaactcaatatacagcattaattcctctctgacagttattcccagttttcgattcatatttgtattatgctttcttgctgttccaatactgatataaagcaatgaagcaatctcctgtatcgtatatccatcaacataatactgaagaaccatcctctctgacggagtcagagtttccacacgcaaagcaaacgccttgagcatttcttctatattcggaggaatgcctccattttccagtttctccgtattcctttttttctgcataaaatcaaccagtgcatccacttctgaaatgcctgataagttttcgtccgtcagcgtatcctcctgcagtgcttttaaactccgaagaatcggcttcacaaaacgatgggacataccgacagaaacaaccaataataaaatcaggaacaacaacgtaccgatgatccagtcccttcgattgtccgctgttaatttttcataattcgcttctgatattaatgtcagtaccgcaagtggcataccattacaactcttcaatccaagcagttcatgcctgcctatataattcccgaaagcggtagaatatgtattataatattttcctttcttcactgtcatcgttcctgatggtgaaagatacgtttcttttgtatctccgaacatcgccttatccagatagatgtttccttttttgtccacaggagccagtactgtcactatattcccacaggaaccttccaccataggataagacagcctgaaatacagattactcatctccataccgcacaaaccgcgtacttttccggtactgtctaaaaccgggacatataaaagctgcacatcctcccatgtatcactcagctccagccggtctgtccacaggcagctctctaccagccggtttccatcaaactgcataatctgttcataccccgacaatgcggacgtatcaaattctaaattccaacggttatggagctgtacctgctctgctcttgcaatatcagcatttcccctgaaaaaaactacgtgctgtttgcttgtatttactgcctttaaatcagacaggcgcaggtagattcccatacgtgatatatctgcatattccgtcttcgtatttaccgttgcatccaatacaacaaaaactccactgcagtacttcacgtccaatgccgatttcaaggagggatacagcgcagcctccaaatccataatcaactgaggattatcattcaaatctgaaaatgtctttccattggctgtcaggcattgattcaattcttttgtaatgtcttccgataaagaaatacttctcgccatcataatatcagtctgctctgtcatagttgacaacgtatttttctgctgggcagacaacatttcccgtactttaaaatccattcccggaaggactcccaaaatactgagtaatagaactgtcactaaaaaaagtgttaaaatcaccacgcaccaataaacaatcagtctttgctgcatacggatgctttgtctctttattccttttataatcttccaaaaatttattttcttttctcccatatgtcagccacctctttttgccgatccggcagacattattgtgtgtatgctgctttgaaatcctctaatgtctctgaaacaagtttatccatatcttccggatgttcctgccactccaaccgctttactgacagggtttgcctgataagttcttcaaactttgtttccagatccagataggaatccaatttcggagcagtataaaatgtatagttctcctgcgtctttaaaaaagcctgatacagggatacatacatcggatcacttaacttctcgatcgcctccggaaggtaaatatcgaaagcttcctgctttaccggcatatatccaagactggtcacaaattccacattcttttgggcctccgtcagccatttaagaaacgtaatacaggctttttctttttccggtgtagattttaccgtacaaataccggcaccccgctgcatgaccatcgtttctcccctggcaaatacgggacatggcatggaaacaatctctactttttccgatgtattatccgcatacgtaacttcgtctgaataatacaacacgctggctgacgaagccaccgatacaatcgaatctcccgttcgcaaaggttccgttgcataaccgctgcgaagccatactcctccggacagtgccgcttttgcataaggttcccatactgtttgaaattccggtccgaaagccagattttctcccttaaagaaattttcacccagagattctacacctacctgaaaatagttaaaatgataatcatgaacgaaaaaattctttccatcatcaggaatgtccggcgtctggttatctgtccatgcagcatattgttctgccattgcgaagagtccttcccatgtttttaaatcttccatcttcgctcctgtttctttcgcgaaacgatcaaatgctgttttattgataaacataacttccgttgattttgctaccggcaaaatggaaagtctttcatgaatgacaccttcttccaaaaaagccggaatgaattcgttcagttcttcttctgtaaaataatcataataatctacaagttccgtatcatccggcatcgccagaactgttttaggataggaaacaaacatatccggcagtttagaggctcccggatctccaaatgcggatgccagtacattttcatgtatcgtattcgtatttgtaacactgccaacctgtactcggatattttcctcttttccaatcgtttcattaaattcatcaatcagatcgtttaatggcgattctgtctgtccgccatatacatgccacaatgtaacggttaccggatcttcttttttcttctgcccacaccctgtaaaaactataaccgcaatcattaccaagaacaggcagcttcttctcataatatatctcatattatttatctcctttccagacagtgtcttataaacaatctgacatctcaacgaagaaaagaaccatcggattgagacactttcacatagtatatgatatcggttttcagagtcttaagcactccccatatgggtagtaaaatgctatttttaaaatccatttataatcagatttttctttgtaacagctaccgccaatttcgttttggaatcaaaattcgttttctgcaacatatttttgatatgccattttacagtttccggtgatatacacaagctctctgcaatttttttataggattctccttccaccactaatcgcagaactgctaattctcccggtgtaaaatcacagcttttcgccgttccgatcatcacaaccggcggagcatccggatacacgttctcccctttcatcgtacgatccataacctccaacagttcttctttaccggcatctttataccaaaaactttctactcccgctttgcgcgccctgtcaataaaactgcactctactaaagaagtcacgataattacttttatctggggcattgtctttttaatcttctccgctgccacaagaccactctcatcattctccgtacagacatccatcaagacaagttcacacctgctctgtctgcatacggtttctgccatagctgcgtttgtgatagaagccgccagacaatatctcccactggactgaatataattttccatatcttcccgagccatacgctggtcttccacgattagtacccgtatcatctccgcacctcctttggtatcttaacgattattgaaaattttgactccgcacaaattctcaatgtacctccacattgctccaccctttttcgtataccggataatcctcctccttctttgacatccttctccgttgtttgtccattatctgtaatcaccataatccattcttgttccccactactgcattttacatacagttcgcttgcccctgcatggcggacacagttggaaagtgcctccaaaagtattatatccatcagttcgaaaatatgagattcccagacttgttctcccgtataaatgattttcacacccaaaatctccgctctttcctgcacctgcttgtgcagttgttcgcctttcacagactcgttatctttattcagcaagtctaatgtctgcttccattgcgaaaggaaaacatcccggtctgcttccgattcgcgcagcaacatccgctgtgccgccaggacgctatatcccagattatcatgcactctcattttcatagataacatttcttcttctctggtcagcgttattacattcttagaaagttctttcatagccacagacatttcctgaagtttctgattttcttccttcagcaacactttgttccgatataattccgacacttcagaagcaagaacttgaaaaaaatgatctccggctgtcgtaataatctctttctctgaaaatttccacacacttccatcggctaagcaatatactttcaaatcaacatcataaaatacattctctttcagaggatgtcccagtgcttccttcagttctgtaatattctgtatatctcttcccgccagattctgacaaatttgatacattttccgattcatcagtttaggcattccgttcccatcaaaaaaaacaattccgctcggcaaattgtccagactttcctgaactgcattttccctcaggcagctcttgcggtacttataaattccaaaaatcttcaatcccacatataaaaaaacaccaattcctataacaattaaaatcacatacggtattttaaataatatcatggaatcttcttcgtaaaacgcccgttgccacacacacaagacagctgttataaggaaaataactataagcaatacactgtccggcagcaacatctttctttgtctttttcctgttccttcataaataaccagaatcatacacagcaaagtcaaaaaaataaaaaaccaaacaatcgtaatctgatactccggtgaacagttttcaaatgtttttatcatttgccgccacctcctcccagaatcagagaaagcagccatgatccgtcaaaatcctgctccgcataagctccatatcgtcttgcaatttcctgcagatccgttttgcattccacactcatagacatgatgatccgcgcctctctgcgtttcagatttacgttaaatgccgacagatcttccaaagattcctctatgactgcttcaaaaaaatcataaatctgcatagcatcttcacttcgtatttcttctaacgcggtggaaaaacctgcctcaacatgattccattccagattctttatcgtttccctgaaacataactccaactctcttatcggaaattttactgtctgctccgcaataaaaataagattactacgcctttttatataggctccgatcacaactatcttccctaatattttttcccttttgttctcatcttcttccatagaatatgcttcaatgaattccgtcaaaagtttactctgccttgccgtctgtttctgtattttatcatacaactgattcttcacagaaagtttttctacttctctttttgttctcagattttcttcctcaatcagattcgcatcttttaattcttccttccgatcttcaagctctcttacgatttcctgtaattctgacaggttttccttccacaacacatagcctcccaaaattggttttcccgacagcctgatcccattttctaacatgatcggacattgaactacctgccttacaatttccggtgcaatacattccgaatcctgagattgataaatgcattttccactctgatctgtaatctgtgctgaaattgtagatgctgcaaataattgtgcgtatcctgtattggaagggatcaatccgcactggatgcagctttcaatgatcaaagcaaacagaaggcataatgcagctgtcatatcgcttgaaaatattttccagaagggcagattcagataataggcgatgccatagacaaccgacagaccataagcgccaaaaggcatccaaagcattttcctgtttttaatttttctacaccttaatagaataatcaagagtgccaccagcagacatccaagatcccaggcgactatagcataatacattgctccatatccatagactcctacttcataggaagctgcttcccccagtcttccctccgggaaagtaaaaactaactggtgcagatcatttgttaatacaatccctatcaaaaacaatgccggaaaaaacagcagacaccgtctttccggtaatttataattctccggctgccgtatataaaatgccagataaagactgaccgtagggagtaacagcataggaatataataaagataccaggcgtagcgcagtgctgtcggcatctcatacggtatttcaaatttacacatacgaacgagcatccaaaaaaccatcatcactgcaatcattattaaacaacgacggggttccttttggataattctcttttgaaaagaaatcgcccataccagataaagtcctatataaataaaaggccttaaaaggtgacaaatagattgcagataaggattggtaaaggacacataatgaagcagaactgccacacctacgcatagcgctacacttccgacgtatactgtaaatttctttttctctgacactgtgcgtactccttcctgttacattttgcactatatcttgtttgcagtatatcataatctacattccaaattatatcttttatttttcaggtgtatgtaaaaaactcgactttgccattgcagctatatctccaactccattttttaatgcaatactttggtcggacaaaccttcgtacattcataacagagtatgcactccgtccctctctttcgtttgcgggattccttattgacctccacattcattgggcagacacacagacattttccacaatgaacacatttgctttcatcgcagtgaacacgcaggattgaaaaacagtggaccgaatatcttcgcgactgcttagtggattgttgccgcctcaaaaacaccaagaaaatgtcgggcatagcgttttcctgcagtaaaaagtgctgttcccaacgcaaggcatcctccaatgtagctgaaattcaacagatagaacaagtttcctttagccttccacaacgtgattgccactgtctcaaataacaaaaataatagaagtgacgctatatatttgcgaagcacattattctttctcatcaaaatcttctaaaagctcctcttccctgtattgctctctctaatgtgtcttgatttctgccttctggcaggtcgtatataaattcttccataattgaatattacggtgcggcagagccgccagtccggtgtggcgagagccacctgtccggactaacggagccacctcagtttgtttattaagttactttgccattgctggatccagtccatatacttctctcatagagaggtctttagctgggtcaacactttcaatatcgattttataggaatcatacgaaatacgatccatgatagcatcggcaagagtactttcaccatcacagatttgctggtaccattcactttcacggaactgagaacaaaagattgttgaagattttttacgtcttttatgtatcatttcaaaaagatttctggcttcagcttcggtcagtttaagaagcagccactcatcaaggatcagtactattggcttggtatatttcttcaggacattcgagaaagttccattgtccctggcagcctgtaagtccaataatagatcaggaagccgtacataccgtactgagtaatagtgcttgcatgcttccatgccaaaggcacaggccatataagttttaccacttccggttgctccagtaataaagatgttccggtattctgtaatgtattcacaggttgccagacggttgattagtgctttgttcagctttcgtccagaatggtaatcgatcgctgcgatgctggcatctggctgttcaaactcagcctggcggatcagccttttcagacgattgtttttacggttgctatactcgacatcaacaagcataccgaagcgatcttcgaatggaacttccttcattgcaggatcatccatctggatgcggaatgcatctgccatagcagtcagacgcatttcaataagtttatcgattgtactttgatttgtcatgattgtttacctccatagtatttggctcctctggttatgccgtgtggtttttctacttgagatgattctgattcggtatcaggtgcatcctttgttgcaaccaatagatttttgatacttttatagctgggtttaccggaataagagagcgccttagcgcagacctgttccagcttttctggcgaatatttttctgccagtttcagtaatcccatgcagcttctgtaggattgctgttcaatcctgccggaggtaagtattgcatcgacaaccttacttgtgttaattccaatcgaatcagcccacttacggaaccggtcaccgttccattccagatatttctggtgttcctgcggcatatgttctgtcactgtagaatactgactgcttcttccatagagtcgtctgtgagaggcaatacgattgtgattataaaatatttcaaccgttgtatctgttatacgcacatcaactttatttttgatatactgataaggcacggagtagaacattctgtctactgcgatgtgatagttaaactggacggtggcttgtttccactcagccagttcaaaaggtgtagcaggcaacggagccagtaatggcatttcttccccaagaaataaactgagtctgctacattcctttttctggaatttacgggcgttgtaggcatccagtttttcacggattgaagcattcaattctgcaagagagaaaaactgttcattgcgaagggctgctgttatccatgtggatatctttcctaccgatccctctacattcggtttatctttgggtttccggactctggccggaaggatggcaagattgtaatgttctgccatctcatgataagttgtgtttaaggcagtgttgtaccagtcactctttttatgattcactgcggttgtgcagttatcagaaacgagcataggtgtgacaccgccaaagaaatcaaacatctggatatgagctttgatccagttgtcagttttctcattcatatatgcttttacaaaagcatactgactgtaagttaatacacctacaaatatccatgcatctgttatttctccggtgtccggatcaatgatgtgagcagggtcacctgcccagtcaacttcaatctgttcacctggttttctagggatatgcatggtagccctgcgtttttcttcatccttctggatgtagtagcagaactgagaatacattagaggctcttcgctgttcatgcggcactcctcacagtattctacccagagaagctttttgtttacgccgttccgcagaagttctttgcggatgtagttaaagtttggcatacgtttattcgttgccgacttatctttaggaaacatcagctcctctagtgcactgtcggtcatgtcaaaatccagcggccatgaaagattgatttccgctgcttttttcaaaaccttggcgactgtgtttctggatacaccgcaactctgtgcgatgttcctctcactgaatcctaagcttttcaagcgtaggatttcacgatacttggtcataacttacgacctcctttatctgtattcacaccaagggtgtgtctttacagtataaaggaaatatatgtaatagagcccaataaggtggctctgaattaccggaatatatggctctcaaagtccggacaggtggctcagagagccccggaataatcaataatcctgtactcattgatttcatactgtcctggtaatggaatatactcttctataaatgaatcttctatttcttcaataagttctgaattatcttcgccatcatcttctaatttaaccttcattttctatcattccgctaattttctataatctcccagtagccgctcttaggcgatccatgtcttataagtatggatgatgtttcgttttccttctgtcatttgtacacgatgtacaggtttcttttgtcttgccataataaaaggccctcctaatgatatttattgtatcatagaagaaccttataaacattattttacagaaaaagtttcatactctcatggttgtcaaaaaagacactgaccgccttactgtaaaaatttttccaaattagtgaaacctcttgaattatcagacataagatgataatatctaattaaacagaaagcacccactccaaaggtggatgctccgagtttaggttaatgaatgtccttaaggacaccgcctatcctgttggcagacaggataggcatttttattttcgcttgtttctcttatcgagaaaggcaagcaacgctacaatcaagctaccaaaggacatcagcaatgctaatatcccaatgaaaatcgaaatgatctcataagctgtcatcggcgccacctcccttcctatgtattccggttgcccggtatcataaaactcgggaggctacctctacgctccgctccggtcggcgctaaacaagcgtcccccggacgcttaacgccctgtcatgggtactttccttagatagtatcctaacataagaactaatgcctctgcaagggaaaaattattggttatcaagaataaggtctatcatatcttgctttccattagtgtatgctactctatcatctgcatacttactttccagttcttcctttaccttctgatactgcaaagccatattctcattatcatttagataatctctgaaatgaatataatttttccactcagtttcgttccatttcacaatatgaatatggtgcgttcttgtatcattttccatatcgcccattacataaagaagctgacgttccacatctgaaccacgataaaatattcccacttgtcgtaattgctcattatgtaacattactttatcaaaatcagttaccccaacgacaatatcaataatcggttttgctttaattgccggtattgctgtacttccaatatgctgtatatcaatagcatcatctcctaatatagatttaagtattttgattgtttgaatggcagcctcatcccactgtttatcatgtggttcaagctgcactattcctctttttaatcctaatgacatagcaatctccttaatattacatcacaatttcactgtcgaaatattgttcctgaaaatgaatctgtctcctgatttcttcctttgaaaaagttactccgtctggcacaactacccacttttcttctatatcatcttttctccgaacaatggcaataattttacctgtaaacttctttactggttcatttacacctaatatataagcgtcctgctcttctccatctggtgccataactccttcaatgtaaccataatttattggataatacatatccttatattcaggatgataacttcctaatggtctatcgactgtgacagttactgttgctccaattatagaattatttttacctgtaaatacttttctatcaatttcggctgtatcaacggatatgtccagttctcaggcaactcatccataagcacaactttctccatttcgctatgtaattctttcgcaaactctgttatctctgcaaagcaaagcagtccaaatgtttcttcaccagtatcatttactctagtcttacctgtcaccgaatatacgcatattggttttatctcaaatttgatagccccagtctcttcctgcaactcccttttagctgtttcaaaaatatcctccccagcttctctatgccctcccggcacttcatatgtatctctttctttatgtttgcaaaatacccacttgccgttactctgtgagataattactgcaaatttcaatagttcatcattaactgtatcataaaattttacttccatcacattttcccttcccattccagcataaactcattcagaaattcctgcattacaacctgtctatattcttccagtttctttccctcagtcgtattcatcatgtctttcaacaaaagcaacttttcatagaaatgattaatgcttgtagaatcttgattattccgatactcttctttattcattcccattttagattttatttccggatcataaatctttcttcccctactaccaccatatgcgaatgttctggcaattccaatagctcctatagcatcaagtcggtctgcatcctgcacacattttccttctatggtatcaggtacgactgaatcagttcctgcaaatgaaacctcatctataattttgcataccgcctctatccttttaccatctattttgttaattgtcataaaatcaactgcatttttcttggtaacataagtgtccggagaaagcttaatatcgtcaacatcatgtaacagatccgccaactgcactattttaacatctgcattttcctgttttgcgattttagtagccagtttatatactcgtattgtatgataatagtcatgaccactactgtctcccgaaaatatactttttataaatctcttttcattatctgtcatcttttctcctaatcaacctagcaaagcaatatattgatttacgaaagtcattactccacccacaaatagagccaaactagagccattcgataaaacaaatgccgaaaacccgcataaatacaggctttcggcattttagtccgttactcaaactcggctccgtcgtatcaaaacttaacggaattaattaaggttttacttgcaatatgccttgtttttatttctattacataatttccattggctttctgataaactgttgccagagtgttgccatgaagttattatagcaaaggatcatagaaaagcaaagacatcttttcttcatacctttaatgcgtttgatatacttaccgcttcctacacatattccataatacatctttttgcttttacagattctcttttctttttataattattttttcacccgaagaaaaatatacccggggatattcatttccaaatccgtgtcctgctgccgaatatgctatatatccctcatcaaccaacgaaatatcattcaactcaagcgaaataacagaactataattagaataattcatcttgctaatattcaacaaatattctttaatttttatacccttattgtaataaagcaacttacaaataccatccatgccaacctgaaaatctgttatctgaatttgttttatattttgatcactatgaagtgatttcacaaaaatattagagatgggaatgatatctcttaacatatgggtaataatcgctgcatctttatatgtcagttcatctggtttactacatgcaattatcttcttactatattcatcatataacaattgacttacaaactcattagaaagaagttcatattcttccctgttcaatattttacgctgtaactccaaatactcaatacacttctgaatagaaatcctttttcccatttcttcaaaagtggcttcttccattaatttatgtattggctctaatgttattacattgtcataatcttctttgttcaaataaatttgaacctctccacgctgatattgtccgcgaaaaccgatattatcccctttcaatgtcatccaaagcaccttagagaataagtatacatcagaaggtttaaaatctaaatccaggtccgtttgtactctctctaattctgggggcattattttatatggtcctactctttcatttaatcccgtaagtctttcctctcctataccccaacacaatccaaaatcagacaaaaccaatttcccatttaaaactaaaatgttttccggtttaatatctctatgcgccttgtccctttcatgtatactttgtataattcgtgcaagttgtaacatttctaatattttagaatatatattacgtttccgattaagtttgtatggtttagccttaggcattaaataccatgcttcatccttagtttgaggtacaacatgaggacactgtttatcaataacctccataatcccctcaataccttttaacgcgtttaacgcgattatctcatttttaaacctattataacgtttttctttatctaccccaccatactcaaaaaattttgctactataggaaactcgaacccttcatccccttcaaattccacatcatataccgctccattaccaccacttccaatatttctttcacttctaaaaaagctatacaactcccctttatacttttttctaccattcatcttctgcacgctttctttcaaaatccgcttcacgtttgtaaatgtcacttaaagtaaaataaatttctgcagttcttggatattgctcttgcaatccttcagcattctttttgtacctatgatgcaaaatcaattctgattttcctgcatcaacagtatgaacacctcgtttgttttcttctgctactacataggaagtcttcaatgagtcagaatgatattcttcaataatctttcgtacagcttcacatggactatagccatcttcaccaattggcgaatatgccagtaatcgtcctaccaaatttccaaataacctctcttgcttttgactgaccaacaattctttaaacttttctatccagtttttcagattttcatatgatactttcccatctttctctgtcgggcaaaactttgctttgtcaaatcccgaatacattttgcttgctaattctctctttttcttatcgctaggatcatcatcatccgctttataaataattctaaccaattgagcatagaacgtcggatcattcttcataattttttgcatgcatttcatttgttcccattcaagcacatttctgcacatccattctaatgttgctaattcagcacatttttcatcatccataatgaaagcttcttgtagttctttcaaaatctcctcaaggtaataatctgtcatagaactagccacatcgcccttcaaattggagattgcaaatatagcattatataattcctgaaatgatattttatcccttatatcatacaataattctaaatacgtatggagtgaaccatattttttacattcatccaacgcccacataaatactttatgctctgctttatccgatatccttagtcttatatttctgctccaatacattttctttatttcttcatcttctttagcaataagtgcgttgtcatcatcctctataaattctaaggtaattaaattcattaaaagatttttattattggatagttttttaaccattcctataacttcatttaaatctactgatccatttctatgtagatatcttacatagtcatatacatctttcccttcttcatctaattccataagtaaaatgaataatttctcatcaaacaatccatcacaataaaactgtgctagaacttcgcccaatatgctatgttcttctttcacagctaatttgatcaacttttccagagaatacttcttttctttaaactctttgaatcttgtttttatctcttcctctcttaatatatgattcttctcacgcaaatccttacattcttctcgactaaaaggcactggatgtaatagaggaaactcatatacaggtgaaaaaatatataaatattcatagactttatcagacaacacaatttcattcattgtgctttcatatttacacaacatctcttcggatatactccaatcagcatcgtgataatacctatgtctataaatctcgtacctcatttcattttttattttaattttctcctcatcacacatttctctgcaattgagaatcaattttttaaacacttcattttgaatcgtcacatcatacgactttatatgctgaattattttattccatttttctgcatccgtacatgctgaatcaacacacatcattaaatattcgatatacgttttatttacttcgtgaacgtatagctcctcgtgctcatctatctttctatatttaggtgtgttcaacgttgaacatatcgagtttgtcccttgtggcaatttagacgcaataacatcccatgcatttggataattctcaattgcctttcttgccaactcaatttttttatcaacagacaatgcactttcatttatccacgcacaaaatactatatccaagactcctttaggactattgcttatgctatacttcaagttatatgaatctactttccataaccactccaatgcccgtacaacatatttcttttgctgaactagttgctctactgcccacaaaacattagtataataatgtctgcttgtcataaagtccccgtcatttgcttcaaacaactccagcaatccctgtggctgtttcaattcatcttccaactttcttaaaacgctctcaggcgaagcttcgcataaatctgttaaatattgcgaaatatatccccatctttctttacttgtaatagtatcaagtactcttgatactatattgtcaatttgcttctgattctcttcatgacctctatagtacgcacgcattataagagttcgaatcatccccttttttaaggttggtgaccactctggtttttctgcataaatacttgcctcaaaatgtttttcaaaagggtaatcaaaaataggctctgattcaatcaaaacctcatagaataataatataaatttactccataactcatcagtaatataaatatctagttcttcccatgcatcctctacactagcaagctgcaaattgctccctctataactggtattagttacaacgaatggattttctctatgcaagtatgtctccagttccttcttacattcaatatatgtcttgccagataattcttcaaaaaccaacacatctcctgttgcttcagtccactcaccacacagtaatgcagtcataactacatcagaatgcccctctacccagtctggtttactatacattgctccattaaaaagttttttctttaatggcacatataaaccatgggtgttatctacgatgttatatgcttcattgtaatctatcccaatctcttccaacgcatttataatgtttctttttgttctttttcttaataccactttatctctcgtatagcatggttcatcttcaccgtatacaaaaatattagtattatttggaatggccacaattttctccgcataaaaaaatgggaccaatatattacccgatacatttgctttttgtaatttattccattcttcttccgacttaattataagagtaactctatctgaattcttctgtcttaattcatttaaaagtcgataggttgtctcctctctagatttcccaacaacatatatcctctcatcatttataacactttgaaatcttgattcgaattgttcatcatcaagtttaaaaaaatctaaccccatccctttatactttgactctcttctaatctggatatcaatgtcagtaattgaataggataacactttttcttcttttaaatctgctatttgatttaataccaactctaattttgattctaacgcaaaaaaatatttttctatctcctttttcaaatctcccaaaaaaatttccaatgtcttatctggatcattttcttctaaatagtttataataacttgaataaaatgatgaatatatgtttccgcttccattgccggaatttcataacgaaccatcaaatcatataattctctatgcaatagctgaggaaattcatatcctctcttatcttttaattttttcgccatttgcttcaaattatcttttgaaaataccaaaaacagatcctgttcaaacatggttaacgtatcaggattatttacacaaaaagaaccagtactaacaaacaattcttgccatttataattttccttcacatcttctatttttgtcttgacaccatctaataataaatcaattgttgtatctttcaatttttcattcatagtctaaatccctttctcaactatttacatatatcaaaatagtagcctttaagagatgtcatcaatttcaatcatatcttccccgttctgatcctttaccgagaaatcacctttaaaaaaccacttatacgcacgttctgcaatgatcttagtttccaccaaatccaatccaccaccaacgatagcacctactcccggaagaagctttcccaaattgacaattcccttcgttccaaatttcgtaataaacctaaatcctactttttgatttattttcgttaaaactttacccggaattttcttaataagtccatttgtaaattttactccgatttttataccggcttgctttaataagccattaactgcgacgccagctaaacaagcatatatgaaggtttgtgtctgatcactatctaattcataatctgccatatatgcaacacaggcaatcatcctcatttgtacatatatcacactcccaacgttagccaggatagcgactggcattgtaataaaacctccaaatccagttactactcctgaagttgtgcattttgcaatttgattttttaacattgctctgcatgcttcttctgtcgttctatgttttttcaaataatcattagccagttcctcaacactgggactaacttttggtattccatttaaacatttttcataacaagaatccaaaagcttcataatatcttcttctgtcattactggcttcttttctttactgttcatacaacttcctcatatctctaataactcatgactgttaccggaatgtctttatacacaggagcacaacgtgattgtatgtttgccaccacattatcaatcacgtctttagaaaaacctctccccctgacatccaaaactatctcctgtgttgatcctgcaggcaaattattagccctactggttacttgtctttccaactccctatataattcacttctgctatttgaggatgcaaggttataattcttcacttcaatcgctttaatagatccatctgcattttttacaacaacatccgggcgtgttgctccttttgtcgcagatgaaacttcaacaccgtccaaataggaaatctgttcttctgcccctttggttcgttcaagaacttttaattccgattctcttggtgtcggattgcttcttgcagatttagccaaagaaacggtttcagatactccaccagaaacaacaccaacaatagctccccatttaaagctttcactaccggcaagtgcggctgccttaagggtctcctcaacatttttagtttctatgccagttacaattgctgtcccagcagtactaattactcctgatgataatgcgaacgttgcgccagtttttgcagatgttgcaaaaaccatacttaccgcagcgggagctccaacaccccctgaagcaaccgaaaccgtagcacaaaccaaaattactcccgtacctattgcaacattcttgattacctgttcatatgtatcatcatatttttcaaaagtttttgtcgttgtctgcccatcatccccaagagtgaatacatatctcgtcccatcatattgagcatccaactccgacaacgtataaccaaaatatatattttcttgagaattgtattcaacttcttctaaatactccttagaaatgtatatcgcatcaacactctcaacaatataatcttcactggctaactgttcagttattcctgcataaacctcatcttcaacatactgaagcaaattttcatcacttaaatcagaaaaagtttccggattaatgtctaaatctatatcgtctatggaagttacatcttccacaattttagagtcattcttattactgtcctcatttttcattccagaattacaggctgtaagaaataaagttgatgccatcaatagagcaattaatcttttcattactcctcatcctcctctggcgatttttctgttactgattcctcaggatctattggtactgtcatattaacctttttatcttttttcttctttttaacaaacaaataaacaataaataaagccagaacaatacaaatacttccaccaaccatgctgctcgttgcaaattgagcttcatcgtccttattgtccttttctaccgaaacactctcctcttcttctgcgtcatcattcgcctcattcaagactattgctgattcagacacattctccacaactttaggtttttctactttctccgggatggtaatattcccgtcatcatcaatggttgctccgtctttaagcaatgactgtatatcactaattgcatatcctgtagtcatatatgctttgagaacgctatttgtcccaacatagattttcttaacagtctcttcttctgtgtatggatttgatactgtaatagtgtaaatcccttcatctgtatacttttccccatcactagcaggcttgttgaatctaacatcctccgtaagccccgtcgcaccctcacgaagaacttctttttttacattgatttctaaatatctggattttgccaaatctaaataaaatccattttcagtaattgctttatttgtcagttcttcaccggtagctacatcaaacggaaaaaccatgcagtttccatttcttactgaaaaagtaaaataaattttgtaatcattgtaagtacttcttattgtcttatctataaagggcacagtgatttttttatctctaatactgtagtctaatgcaacttcataatcgccctcttcacaaatttctacctgagtatttgctccaactttaactccagacaaataatccgtatacaattgagaagtaccttttttattttgatacgcatctgtctttcttataatcaaggctcctcttccaaatgcagtctcatctttatacagcaaattatcatatgcctttttatcatttgcaatcatgagcgatttatcattattcaaagcatcaatgtcctgttccaattgaaaatcaagaacaacctcatcgcccactgttttcaaaaaaatcggatttccgtcatctgtaattacacgagtatagccattaacagaaaagcttccaagcgtccaattataatgcggatccttctttgtaatctcattattttcagaaaatccagtatcttttcccgcattaaccgcctctccaagataatatacattcgaactattagcatttgcgttaaaaggcattatagttgttaatactcctaccaatgctaccgataataatcctctagcaattctacctttcatttctgatgctttttcatttggtcttcttgattttaaacttttctctttcgtatacctcatgcttattttctccatctcttttatttcgtatattcaaaccattacttgtcggtcacaaatctttttgttcgctattattacgttaatttttacggaacgtaatacctcaatataaaaaaatcaacatttttccggttgatattattttaatccatccctttaacaatatcaatcaatactgttctctttccttgtctaattaatcacttctccatccacatgtaattcaaatttttcttggttatcacatatatcataattctcattatactccctctgaacataatcaatttccatcactacatttgcatcttcaatatcttcttcacataaatatacttgcatatgaatttcagtcgcatatcctctatctgtagaaaacttaattgtatgaaatgaattttccctacacatcttcaccagtaattttgcgaattcttctttatcttcgatccgattccgatttgcaactactgtaagatactgatcccgattcatactgatactgctaaccacatccggctccattgatatttcttccttagattctttttcaaaaagatatccagtcataatactaaataccattattacgcacactatacatatacgtttcttatccatacttctaatccttctcgtttgcaatctatgtattgcaattatatgaaatttttcaagtaaaatcaatacaagcacagtgatgcaaatgaaaggtatggattatttatggagcaaaaactacgacaaatcaaagatgtttccattggaaataatttacgaaatttaagaactgcagctaatctcacacaagaacaggttgttgctcaattacagcttcggaatctttcaaccacccgcagcatttactctcagattgaagcaggtacctacaacatcaagattagtgaactcattgccttgactgaaatatttcataccgatttcaacacaatatttaatggactatcctacaataaataaccctggatcaacagttttcattctgccatccagggttttgcttatcagtcttattctccaaatatatacgagttatagttccattccacttctctgcttcctctttgtttgttgctccacgatctgttttttctcctccaaccgttcatgaatacttcttttctgtctggtacttttctgcacatccggtgttcgcatattgctcacattcgccggaatcctcaaatacattttctctggttgtggttccggtgcatcccatgctttttgagctatctgaactttcttcaactccgcttttgcaagcttcattgcctttgtaacttccagtgcattttgatatccatgctgatccggtattaaatccagtgtatcttttgccttttccagttgagctttcttcgcatcaatctttccttccagttccttctgctcttttttgtgaaaccatttcttttttacttccttcagatctttttccagtttcacgatggctttctcaatggaatatatcttctgttcctgctttttcatcttattgagaatttgctgtaatctcataacctcagcttcctgtttttccgaagaaggtctttcccctttgggttttgccgacaatggttccggtgtaatgtcaatccgcacatcatgatcaatcagaggattccctttcaaatctctatcgcagtattttgtctcccgcagaaattctacaaagcctcttaagtatccgattgctttctgaagaatcccggtaaataatctcggatcctgtccatgctcccggagtgattctgctaccggcacgtcaatctgcaattgttttgctgccatcacttctgcctcggaagcacctgtaagcaatgcccggtccacgttccggttccattcctgacgaagataattatccgctttgatctctgcttcttttggattgttcttccctatctttttggtggcaagataaggactgtctttctgaaatacctgtagcttctcattttcatccttcacaatcccgttgattgcatccgtcattacctgtttcatattctccagaaaagcattggtcttaaattcttctttctttggctgaaagaaattcgtctcatagacttccccttttttgatgattttacatccgggtcggacattcccattctcgtcaagaatctcctttttcgtccgtacatgcttcccagattcattataaaacatatttctgcttgcaattttccgttccacttcctgccggatctccttctcagaaaagatcagatgaatatgaagattggttttgctcttattgtgatgcaatgccgcacagcatcccacatcatatttctccaggaaaaccgaagtcatatacttcagcaacagttcatgatcctacttgatcagactcggcggtaacatgataatcagttccctcgcttcaatacaagttccttctgttccgctttttgcaaaatcccgctgattctgttcagcaagaagctcccagtagctgtcctccacattggaaaagaccgcatacaaattttcctgccgcttggggctgctgatataatccactctgccttttacatcatgcagcttgctttccatcacaaagctatgatttcgtctgttcacaatacctcctttccgcccggatacgctaccaaagaaaatcgtcatcggaatggaccttcatggcattctcaagtcatgcaaaaacgcccctgcgaggcctttcgggaggacgaaagacacagagtataagctttcgcttgtgcaatgggtgtatttcgctctcaatcgccgagggctctttttgtcatacccggataattctatatatactgatgattaattttttctgactggcgtatccgccatttttattgatgcccgtttccgggctgtttctcgtttctgctttgttttcaaagttttttcgctcctgttcacaccttcttgttcacattccgcccagatatttgtgaacagaaacctgtgaacagagctcaaaacattttaaaagtaatccttaatcaaatggtatttccatgttctcatccactttcatgaatccttcctcatcttttttcgattgaatccgtttccatgatctctgcgttccgattgccccaccaaacctatgattgccatgtttcgtccagccgatgatctcattgtccatcagatcaccaatttcttttgactgccattttggaacgataccttcctgatgaaatacctgctgatagataatcgtagaacagacataatcttcttcgtacgaatcaagaaatgcctggatcatacctgtctgagtatcctacggcatgaattctctctgaagcagcttaacgtgatcctccatctccggtgaaaaagtcaacagatagttttcgcttcggtagatttccattgcctctgcccatgcctggataatgtataatctggattctgcttcattttcataaatggtggtttccgctttttcgggaaatactctgaccggggcaaatctccgattcccggtacggtcgaaagggagaaaattcaggtcgttggaagtaccgcaaaagacacactgacgataccggtcctctgcccgcctttcatatgggatacgataaatatccttctgccggctcaggaatgatttcgtctcttcgatactcttggcatttgccaccgcattcatttctgacatttccacaatccagtgtccctgcaaatattcataaaccttcttatcatcgatccgcttcatatcgtccgtaaaccattcatctttgattgccagataacggaagaacgtggattttccagttccctgacctccgaccagacaaagcataatgtcatattttgctcccggctcatatagcctgcggatcgctcccatcatgtgcatcttcatcacttccccggtatagccaatatcctctgccccgaaaaaatgtgtcagcatatgttgaattctcggaatcccatcccatttcaggctctccaaatattcaagaatcggatgaaaactgttttcattcgccacgatatcgattgcctttgtaatgacacgatcactggtcaagccatagttcttttccagatacaaagccaggttattcatgtctgtatcggtcatatggacaccacgccttttccagggcattttcttcatgatgtcaatctgacacgtcatttcatttctgcagatagctcctttcagacacggatcatgctccaacgcatatttgcaattctgtatagactgacgtattttccctttttccgtggtatccatccgttcccggatatcctccactgtcagaagctccgtttcaacaatctcctctaaattctgcaaggactcctcgctcatattctgcaattctctgttcataccgcttcacctcctcccttccgttctggaaaaatccagaatctcttcgtccgttccaaacatcagcatgtccaccagataactgatcttgctttcattctgtaaggcttcaacaaatagaggatgccattcctcttccatagattccggcttgtaaaattccttccagaattccatccatcgcagataccgcagcaatacattggcagcatcccttgcccatttatcaatcttcttctggacaaattgaatccgttcctcttttgttggaaccttctcttttttcctgacacctgaattttgttttcttcttatctctggctgcccgattagaattcccagagaaaagtcttcattgatcttcttcgccgcttcgaactgggataatccaaactgtaccgccacataattaactgcatctccctttgccccacaggcaaagcagtaataattctgattaatcttcatactgggatgtttgtcattatgaaagggacaacacgccatcccattccggcggacttttaacccatatctttctgccacctgccttgcggtgacacgttctttcatttcctgaaaaatgttcatgtacatcctcctgtatcctttgtaatcaaattccgtaattttccctctttccgtcacaggagaactttgttatactacacataaagctatatgcgtatagacagacttctcccataaggattgagtttttgtctatgaggctttaccagagcctgcataagttttgtttagtgtcgaaatgtccttgttaccagcaggggcattttcttttttagggatgttccggggattccacatggtgcggttcctccttcatcccattcagtgtcacagcaaccatctggatgttcagaagcagttcttcattttcttcactgcacacttccaaccgtttcagttctccgtagatctgctgcatctgatttttcagggctttgtacactctcggatttccctgcacggtcacttcccagtccatcaattttctcaggatgtactcctgtttggtgagcccagataacgccaccatgtggtcaatcatttttgcttcttcctcggatacccggaatcccaccgtccgatttctccatcgtccttttgcatctaacgttctctccatcagatttcatcctccttctccattctctcgacatccaacttattcgccatctccgtctgcaccgtcgggaataaatgtgcatatcggtacgtgattttttccgcttcatgtcccacccggtttccaatggcaagagctgtaaatcccatatggatcagcagggaaacatggctgtggcgaagatcatgaatccgaataaccggaattcctgtcgctttgcatcccctttccatttcatgtttcagataggatttggaaaatgggaagatccgctgatccggtgccagtgaataatacatctgaaaataatcctgcatctcttcacagaggaactccggcatcacaacgatccgattacttttcgctgttttgggagaagtaataatgtcctgctttttcatccggtggtacgttttattgatccgcaccgtctgtttctcaaaatcaaaatctgaccgtgtgagggcaagcagctccccttcccggattccggtccaataaagcatctcaaaggcataataggatctgggcttgtccatcattgcttcggcaaatttcagatactgttcctttgtccagaatttcatttcctttggaacctcttttcctatacttcctgcctgtcttgccggattgcagggcagattataataatttaccacatgattgaaaattgccgtaagctgtgcctaaatcgttttcagataatccacggaatagggcttgcccttttcatcccggtatgccatcatttcattctgccaggcaattacatccgccactgtgatctcgttgattttccgttttccaaagtaaagaaggatttttgtccgcacaatgtggcttttcgtctcaaatgtactttcctttaccctctgacgtttatactcggaataaatctcataaaagctctcaaacgtcatttccagcttatttccttttcgaagcatcatctcatgttcccatgcagtcgcttcccgtttggtcttgaatccacgtttctgcgtctgctttctttccccggtaaaatcggtgtaccgaaacaccactctccatgtacctttgtctttttcctgatatacagccatcttaagtacctcctatttttcttcataaaacaactttttcttgaaataattggcatccacacgccccggcactgtaatcagccccattccgctgagttctttattcagctggcgaataatctggtatgcctttgactgcttgacctgtaaaatatccattacttcttctgcagtcagaaatccattctttaattcagacattctattcacctccttccacattgtcttcaaggaaaaacccctctacttatccaaagtttcaaggcaccttatacaacctcattttcaaattttcttcagcttaactctattaagttaagttttgattgtattatattaactattttccgttaagtcaagtggtttgaacatcagtaattaaatttttttgtttaagtttttcttgcgtcttatttttccatatgctatactatttaaacaaatatcgttaaccaccagttcctattcattgcataacggtaggagcttatattcaaaattgaataaaagatttcaggaaaaggagagatccctatggcatttggaaaacgtattaaatttttcagaaacagaaaaggtatgaaacagaaggagcttggcgaacttcttggcttccttggaaagacttcggatgtccgtgtggcgcagtacgagacagaagcaagaacccctaaagctgatctggtcaaagaaatggcacagatcttcggtataagcaccagagctatcaatgttccaaacattgactcctatcttggtcttatgcacaccctctttgcactggaagatatgtatggcatcaagattggagagattgacggagagctttgtctccgacttgaccgggagcacagagaatatcagcacctgtttgaaccttttcatgcatggcaacaaatggctgcaaaactggaatctggagagatcagccaggaagaatacgataactggcgatataactatccggaattggacacctctgagattcgggcaaaagttccgtctcaggaactctctgacgaactcatcaaggctctgaaaaaagagaatcaataaagaaatgtaaaaagaaaaaaccttactgactactctttccaattttggaaacagttcatcagtaaggtttttatgttatagaaatataattttattcaaggaatatagcaaaaagtgttgccaatccgttgccaaaaaataacggaatttgcttggaaatcgcataaatactgggtctatttttgcaaaatcctattcaaactcgacaaatcctaatcaattttgtttagagattattctctgtcgtattcgtggcgcttttgattatttgatatatccatattatcctgcctatatgggctaatgttatcaatttgttatcggggttgataacactcgctctgtaactgcggataatagcaatatgtttcatgttatattataagcgattttgcttagaaaatcaatagttcaaaccgccaatttactgtaattcacaaaccattatatattcttcttccgtttcgcttaccaccttaaaacctatcttttggtacatattaactgcatagttttctttctggacagataaagatgtctgtttatatcccttttcttttaaaaggtgcaatatagctttcataagtgctgtaccaatgcctaaatgtctatattcgccataaagtgatatggcaagcgacggtgtttcatcgtcaatatgcccgtaatcattcataatacgcccccacaccgcacctacaatttttccttttacttccgcaactaagcaccaatcatcttcttttccaaaatcggcaatatatacttgcaactccgactgttcaatgatagcctttggcggcttttccatactctctggaataaaaattgcttcatacagaaaatctgataatattggatactcttcttccttaatctctcgaattatataattcatattctatcaattccttatattcataaattcaacaaattagattttgtcgctttgctattcagctatgtatttttgctccaaatcctttaataaccgttacctgcaaatcctttgcgttaatcaaactttcctgcttgcatttcgggcagtagagcgggaaatttttcagttccgtatctgcccgtagctgcaatctcgttttgtttccgcagacagggcagagtatccatttactatcttccatagaaatcctcctgcgttactttgctctgcctcgttgctccaattccgcaccgtagcgaacaaccattgcaagtaaaatcaagcaaatgccgataccaatgccaccgccgttatccatccgttctgatataaatgcaaacttttccatcgcagaggaaaatgctgctgataaaacatctacaacaataaagagtattccgagcttcgttatgctttttgctcctgtttcagtaaaaggtgttccctcgctcagttccaacttaaaatatctacaaacacaaatagcttcaatcgctccgaaaaccaaaaccacgctttcacagagcagggctattcctatttcacgattgtcaatcgttctgtcagcttctataagtaacctttgcagaagctcgccaaatggaagtttatctgccatcaaacttacgctgccaaccactaatgtaaaagcaatcgccacaaaactgaatcccattacaatcttcgttagtgtttgaaagaccttcattgtcttttggattttttcaagattattcatttttacactccttcgtctttaatcgttgcaaataacaagctcacttttaatgccgttcagttctatgacattttccgcatcgggcgtgtcaaagcgttccgtctgtctgccgtccttttcataggaaatgctcgttccaatccccttcgtaacagcagtaaatacttcaccctctggaatatggattttggaagttgccgacacctgattgattgcaaggtatccctttaaggaattgcaaaccacactcatatccagattgcagttaatttctactgtgccgccgacatcgtttagaatgatattcggcgtctttacatcaagctcaatactgtcgcaatctaaagagcggatttctacggtttccgcattgacagcaccctcaatttttcccacatagggtataggaatttgaacgaaaatactgacagtttcttttgccgttgcttcagatataccgtttttacggattacatctacatcaatccgttttcggatgtcgtcaattttaaccttaaaatcgttctggagcgtagagagggtattagataccagacggacacggattttctctccctcataaccagacaatacaaattgctttgctccaccgaatttcatatcatagcgtttcggctcgtcaatatcgtattccgtaacgctttcaaaaagatactcgtttgattttttcattcctctttcattggaaagtagctcgtcaatggaaatgtcaaacagggcagagatagccatcatattttcaatgtcgggaatgcctgtttcagtttcccattttgtaaccgcctgtcttgacacgcctaacttctccgcaagctgttcctgcgaaagtcctgccttcttgcggatagattttagtttttctgcaaatgtcattctcgtgacctccttatgttgatacgccaagtatagaaaaccgtgctttgcattacaagcaagcagagatgacattcggaattttcctgctactttgcgttgcatttactgattttgagcaaaatatttgatatatcactcactgatttatcattttcacatctgccagtaaccgagatttcgttttgccccacattatttccacggtctgccgctgtcaagccaaccttgctccgcccaatactttccgtcaaggtattcagggtctgattgatgtatggattgctgcatcatacggcagacgagaaacttgaatttcgtaatcaaatttgtgtgtgcgggctttgtataatctatatgagcaaactttcgggatagcttttgaatctttcccgtaagctcggcttgtttcttttgggaaagcttttcccaaacaatatcgctcatcaaagcaccagtaaatatcccgattttagaaattccccaccaagataaactatgcttcatatctttcgccgcagattttgttccactgcctaagcattgcgttataattaccgcacgctttccaaacatttcaggagcaggacggtgcggtatccagcggtaagcgaaatggtcaagaaatgctttcattgctcccgtagcgtgaaacacataggcaggggatgtcattacaatcaagtctgcttccaaaagtgatttgtcaattttcccaatatattctgcgtccttgcaagtgctttcaccctttaatgtacaactcaagcaaccagtacagaagctcggacagtccttcggaagatagtattctgtaatattcgctttatccttaaactctgctaaaaacatctctttcaaacggtaggtaacaccgtgtttttctgttccgtttatcactgttatattcactctttatacctccaaaatatcatgtaaaacttgtgtatgaaaattcttgcggttttctctctttctaaggtcaatccccaatgtttgcgatatgatttcgtatcgcagaaacatttgctgcataacggtaatcaaatacagcgtttttcgccttatcgccgcttcgtcaaggtcaggacggcaggctgcaacaagcggaagatatgccgcataagttctgtaagtgttgtcattttctttcggtgactgcatatcggtaagaacagaaattttggaaatggcataatgttcaaacagaaaatcaagcgtcatattgccgagatactccaacttctcaaaaggagtaaaaccgtctgttttctctcgtatattctgaaaatgctcgactgttccgtttatcatacgctcaatacattgctcgatgagtttatccttgtttccaaaatgataatttacaagtcctaatccaacacctgctcttttgcatatctcacggactgtaacttcttctaaatgctcccctttttcctcaatgagtttaatcgttgcctgtatgattgcttctttattatccacactatacctcctattgaacgacgttcaattatattatactgaacgccgttcaaaaaatcaagagattgcgacaaacaagtggagatataacgattttcggtgtcaaaacgccttgtttaagcagataagagagtaaaaaaatagcgggtaaggagtttatccctacccaccacaattttacggttatatgcgttataattctttaattgtagatgatttccttattgacaagctccatcgcacacgctcgaatgttattcattcgcctcgtccactctaagccatttgccgctttaaactgttcagtcacgccctcacgctccgccatctgttctaccaaccgaaaaaacatttcctctgcctgctcgtcaatatcagcaagatagctgttcagcttgccgcttgtgagcagattagtgtagattgctcttttatgctctcgcagatagcgtttgtgcctctgcccccatacgccgataggcttattttctttttcggctggtagagtaaggcaggggataaaataatccccttgccgtacataagtgccgcccatttcttcaaaaattgtctttgccattgtctgttcctacctttcgtattgattatttctaaagcgtgtgccacgctgtttagactgtcttgcctgttctaacaggctgtcaatctgtctgctgccgaatacctttctcagcagcttgtagtccttaatttcttccctcaatctgttattgtcggaagtcaactgcctattttgacttttaagccgttcattgctacggtacagactggcgtttgtctgattgagcctttggtaatcgtcaatcgcttgaaagcaccgcaccataagcgttttaatgagggatttcaaccgcttaattaacggctcggcaaccttgctcttataactttttgcagtcataaagccttgtggttcggataactgatattcgggggcattctccagtgcgctctgcatttgtgagagtgcagttgtacccttatcaaagttctcaatacgcttggaaagagtttcaaattctgtttgcttatctgtgattttattttccaatcgctcgatttcctctgtccgttgttgctttttataatccaaaacagagagatgtttttcgtgcgttcctttacgttcccacttaattccgtatcgttccataacggcggcaagctgttttttttcggactgtacccactgattccactctgtttcgctgcgggagccgcccttaaatccctgcgccgctaacgcttgtttgagtgatactctcgtatccaatccccgcttgctgccagtagtgaacggaacaaaatcaatatgcaggtgcggcgttgcctcgtccatatgcagatgcgctgagaacactctaagctgtgaatttctctcttgaaagccacgataatactcatctaagacctgccttgcaagctgtccgttctcactttcagcactcatattttccttatcgcctatctgcaaaatcagttcgtggaacggcttttcctgtttggagcttcggattttttcatagtagttttctatctttcggtctgctcttgtctgcttggcgttgtaccttcccagtgcttcatcaaacaattcgtgatagacctttttaatattctcgttgcagtaatctatattgagatgggaacggtcagcgttcacattttctgctttgaatttacggctgttatgattgaccgagcctttcccgaccattgcgcttatcgttctttgcataaatcgtttcctctcctttctgcgccgacaggcgcaagcctttgttactttctgcgaaagtaacgcaaaagcacttttgtcagctccgccaacaaaaatgcaacctgcaagcaggttttgcgctctccgaggggtgagcgtgtgccagtggcacacaagctgcgaaccgaccgagtcggcagacgagacagagccgcctttgaaaaggcgctctctgcactctccgccaaactttaatcggtgtcaatgtgtgacgatggtgacaatgtttgagataccagtgccactcccaaaacattgtcacctttgacaccgtttgtcacgccgctccatcggtttctttccaaagcgaaacctttctgccatcgtgcgtgcggctgttctgatagcggataccataatcacggaacagcctgcttgcgttaatactaagcctaagtgaaagcacattcggttttatatccacaccaagcctttcacaaagttcagaagctgttccttcccatctactactttccgaaaaaagagtaactgcaattttttcgagcaacggctcagacggctctttccacaactccgtttctgatttttcaaagttccacaccaaacgctcggtatctctcacaagatgaattttcatatcctgctgatccctgcccgccacatcgagcgtagcattattggaagttctcttttccttactgagaacaaaagctccgtccgccgcacccatcagtccattcgttcccgaaatcatatcgaaaatatcttccgctttctgttttcgggtatgatgaacgataagcattgtaactttataactgtccgccaacgctttgagcctcgccacaatgtcatagtcgcttgcgtaactgtaatctgccccgccagcttcacggacacgttttaaggtgtctatgattattaaacctgtatcggggtgttcctgcataaatcctctgatttgttcttccaaaccgccattgaccgttttactctccgttgcaaaatataaatcgcctgcttcttccgcaccgaacatctgaaacaaccgtttctgcaagcgagggtaatcatcttcaagtgcgaaatagagcaccgttgtttttctcaccttataatcccacagcggtgttcctgtgctgatatggtaagcgagctgtgccatcataaaacttttacccacctttggggaacctacaaaaaggtaagttcccctctggagcagaccgtcaatcagcggcgtctgtatatcaaatacggtgtcatacaaagctgccattgatactgtcttgagatatgagggggataactgccgcagcatttccctctgcatttcctcaaagctcttgatattttcgttatagtcggatatactatggtcagtacatttttgaattggctgttccgtatctgcgccaacagatacattcggagcagtcatttcttttttattctccattcccatcttctcctttcagaccgccaagaataacggcgattagttcaatgacattcagcagttcctcatccacgctgtttcccgcttcaatcctttgcagttccgcaaggacagcggcaagctcttgtttcagagccttatacaccctcggattgccctgcaccaccacatcctgattaagacagcggcggtagcagtattcctgcttcggcaatcccgataaggcgaccgctttgttaatgcgctcgctttctttgggcgatacccgaaatcccaccgtgatgtttctccaacggtttttgttatctctgttcttagccgacattttcaaaatctcctttccccaaatcgtccaatttatttgccatttccgtctgcttggacggaaacaggtgtgcgtactgataagtgatgtcaatgctttcgtgtcctacacggtcagcaatcgccaccgccgaaaatcccatatcaatcagcaaacttatatggctgtgacgcaaatcgtgaatccgtatgcgctttacgcctgcggcttctgcccctcgatccatctcgtgatgaagatagctttttgttaccgtaaagatacggtctttctttttcaagccatagagcataccgagatattcctgcatttcttcacagagaaaatgcggcattttaatcgtgcgattgctcttcttcgttttcggtgtggtaatcacatcttcgccgtgtaaacgctgataggatttgttaatcgttactgtttccttatcaaagttgaaatcggcggcggttaaggctaataattcgccctcacgaatgccgcaccagtagagcatttcaaaagcgtaaaaggaaacaggtttgtccattatttcataggaaaatttcttgtattcttcctttgtccaaaacagcatttccttgtgttcctcactccccatatttcccacctttgcggcaggattagaacgcaattcataatagcgtacagcgtgattgaagatagccgacaactgattgtgcagcgttttaaggtaagtttgtgagtaaggctttttcttatcatcacgataagcaagcatttcattctgccaagtgataatctcctttgtggaaatctcgctgattttcaacttgccgaaataaggaagtatcttcgtgcgaatgatatgctcttttgtcagccaagtgttttctttcagacggtttttcacatcattgatatacagttccgtaaaggcttcaaaactcatatcaaggtcagacgagttttgtagctgaaacatccgctcccactcctgcgcttctttctttgtggcgaaaccccgcttacatttctgcttgcgttcgcctttccagttcacatacctcgccatcacataccaagtgccgttgtcatcatttttgaatactggcattacttactctcctttcctgctccatagagcctttcataaaaatactggcggtttacacgccctgcaatcgtaataaatccctgtgctttcagttcctcgttcagctttctgatgagcttataggcatagggctttgatacgcttagttcctgtgccacatcatcggcacggataaatctgttttccatatcatcagtcctttcataagatttttaagttgccgttctccccgaatatcgttcctgcccccatttcagcggcgttatctcgctctctcttgaataaatcaaaaggtcgtggcggagtatcctactcagacggtcatttggtttatattaagcatatccgattagtattttctattatactaagcatatatgcttgtgtcaagaggttttcgagaaaatattaaacttttttgtttcgtttcctcttgacaatccctaaacatatctgctatactgattgcagtacataagcaaggagtgtagacactatggctattggcgaaagaatacatttttttaggcttttgcgtggtatgacgcaaaaatatcttggtacggctgtcggctttcctgaacggagcgcagatgtgcgtctggcacagtacgaaactggctcccgtaaaccaaaagcagacttaacggctgcattggcgcaggtgcttgaggtttccccgcaggctcttgatgttcccgatattgacagctacatcggtcttatgcacaccttatttacccttgaagatatttatggtcttaccgtcagcgaagcagacggagaagtctgcctgaaagtcaacaaggacaaaggtaaggacgctgccgagctttcaaaaatgctctgcgcttggaaagaacaggcggacaagctatcttccgaggaaatcagcagggaagaatacgacaactggcgttattactatccgaagttcgataccacacaaatctgggcgaaagttccctcaaaggagcttagtgacgcattagtcgaagcattcaaagacaaactcactgactaataaacaggaggatataataatgatttcaaggcatgacgaagaaataattagtgaaattgctgatttcaacacactaactttagtaaccactgcatataccctatacgaaaatctatccaccaaaaagccaatatcaaagcgtcaattttatcaaaaatttggagataatcttcaaagtttcaagaaaatatttgctgaagatactgacgaaaaataatccttgaacgccaaaaaagcccttagctatgagttactacccacagctaagggctttataatatggatttattttgtcatacaaaaccaactctaaatcattctgtaacccgtaaaccactggattgcaagaataatggctcttatatgactgttatcaaattgttatcaaaagacctctcgaaatgccgtaaactcgcataaacactgggcttttacgacttctcaatttattcaaactcaataacgcggagtcattcataggtacattcattactttttattatgattttgttgtacgtttttgtttttatttcctttattttttttattacatatttttctaacatcaaaataacatcaccaaacattttattttttctattacatattttcttcatattatatcactcttcttccggatgcacaatctcaattacatctccaatcccacaattaagtgcctcacagatcttgcagataatctctgtgcttacatggccattctttccaagtttcgccaaagtagtattgcttattcctgctagctccttcagatccattttcttcatattcttatctatcaaagtcttccacaaaggattgtacgaaagcataacgattcctccttatcttctttttccttattatagtttatttttccgcttttgtcaaatttatttctgtatttgcagaaatttattccgaaaaagtattgacgtaccgtgtacatatgttaatatacaaccatagaaaacaagaacatacattcggcggacggcgaatgtaaaatcaaggaggaacatgatatgtcagaacttttaaaaaaccagaaattcggagttgaagtagaattcacaggaatcaccagagagatggctgcaaatgcagtaagagaagttgttggaggaactatttccggtccgagaaatgactgttaccgcacaagagtaatcaaggattctcacagaagacaatggaaagtcatgagagacagttccattacaccaaagatgaatgtcggatctgcaaatacggatgagtacagagttgaatttgttactcctcctcttaaatacgaagacatcgaaactttgcagaacatcatccggaagtttaaagaaatcggaggggtgcctcatagcagttgcggtattcacattcatattgacggagcaaaccatacagcaacatcacttcgcagaatggtaaacttcatgctctcccgccaggaaatcatttacgaagccttgaacatcggagcaagaaaagaccgctggtgtaagccgatctgcaaaagcctttacgataccatgaagaaagaatctgacctcacaaaagataaagcagagcaaatttggtacagcgaagcgaatgatcactattggggcggtgtaaaccatagccattacaatgaaacaagataccacgcacttaatcttcatagctttttctcaaaaggaaccgtggaattcagacttttcaacagtacattacacgccggccggatcaaagcatatattcagttttgcctcgccatgtctgcatgggcgatagagtccaatgacaaaattgtattcagaagcgtttccggatactctgcagataagaaagtaactttgatgtatcacatcttaacaaatcgccttgggttatatggtgatgaatttaaaacctgtcggcttcacatgatgaagcaactcaaggaaaacgccacatcagcggcagcttaatacaggaggtattcattatgaaattatatgtagcttacggaagtaatttgaataaggaacagatgagccacagatgtccagatgcaaagccggtatataccggctatctggagaattgggaattgatatacagaggtagcaaaactggagcatatgccacaatacgcaggaaaaaaggataccgagtacctgtcgctgtgtggagcatcagtgaaacagacgaaaaaaatcttgatatatatgaggggtacccaagattttattataaacagaacgtctatgtaaccctacaggacggttccagaataaaggcaatggtttatattatgttcaacggagcgaagccaggaagaccaagcgagaggtatgtggataccgtttataaagggtatcttgatttcaaattggactacgaatttctcatagattcaatgcttacaaataacgatgaactgaaaaaagagaggggataatcctctcttcttcagatctctcagccgttgcagcggctttttccttggacggctttcaagtttccccgtctggtgtgagtgatgttagattctctgttcggtatccgcacaatcaattcatccagctcgcagtcgagcgcctcgcatatcagatcaagatgctccaggtttacccgctcagcaagctcgtggtacaattcgttaatagtgtttgggcgtattccggtcgctcgcgccagatctgcttgtgtcagtctcagctctccaagctttttcgacagtaaaatctttatcattcgccattgctccttccgttttaacttaccatataatggtaatttaagacggaaattgttagattatatcgttttgtgttatactaatagacaattcatggggggttctatagaaataaatgaaagatttcaaggttgactttttaaaagatatggcatattatatttatagctaaggaatgcggtaaaattccatagggtaaaacgaaaacctccagagtgccagctctggaggttttcttgctcgttacggtgagccaatccgtttaggctgtcgctgcctatttatctccgtccagccatttgcatatgtagtagctaactacacctgctataacagagataagaaatgcggtaaaaatttcttccacagggcaccacctcctttctgctggaggttcggcagcaatgtaatcatatcacaatcttctacaatattctacttttttcattaagtaaaagcaggcaagacagaaaacgattttaggcgccggattatgcctttgcgatatatgcagaatgaacaaatccatagattcttccgtcaattctgatgtaataccatctcgatccatctgccgcattaacaacatcacatacatcgaccagatttcccattgagagtttcggccaggatttaatgagtggattgttggtaccggcccagctacgaacattcagaacgtctgcggtaacctttcccgtccactgaggagttttcgtaataactccatcatctttcaatgtggtatctccggacggcttactggttgacatcttagtaatatacgcagcagatacgaatccgtatttatcaccctgtgaaccgctgatttttacatagtaccaaggatccccgtccttatcctttactgtatcgcatactccgactttcgttccctgggaaatggtaggataagatttcaggtttgcgttttctgtaccggcccatgttcttacattcaaagaaccagtattcacagtacctgtccactgaggagttctgttgagatctgtaccaccgccggaatttccagaatttcctccggccggagggttggacggagcagttccctggctatcgtacttcggaacagcatatcctctgatatttccatttccaacagaaagaactcgtctcgcaacagcttctcctttgttaccctcaatacaagtaatctgtccattggacacagattcaactacgccgatatgatcggaatatccgtcattcggctgatatccctgatcccagttatacaaaatgatatatccaggtttcggaacgattgttccatcctcaatccagattccttttgccttgaagatcttaacatgctcttcgcatccgcactctgtaccgatcaggtcaaccattccagccgcgattgctgctgcagatacgatcgtatcacaccactcatctctgtactgcactgcatagcctctcgccaaaggcttgtgactgttatacaggtcgataatctgcttgaactttccatttgcctcgctgaatccaagccagctgcgccatacattcaaataatcctgggctgttcttcccatatttccatcctccttattttctgtatcgtaaaaataatccatgtctatgtctccgttgattcccggaacctttcctttgttcgtgtactgatgataagcacaaggcacatcagcttctccggaataatcagccagccagaacacatattttttaatcaaatccggttcatacatatttctgtagtaatcaagattcgagtaaattcccggagtatatccctgagactctacataagtgcagaattcctttgtgaacaggatacactctgattttccgagctttactccctgggcagcagctttttctaccgtgtcatattcaaaatcaaagaaaacgataacatcttttccaagacctgctttcttgatattttccatacacactgcagcttcttctcttgctccggccgcggatgttgcatagcaaaaatgataaacgcccttaatcgggatgccgtttttcttgcatccgttcacatattccatgaacttcggatccacagtctttctatacccttctctgaggataacgaaatccacattttttgccacttttgagaagtcaatgtttccctgccagtatgaaatatcaataccttttttcatgtatttgcacctcaccattctgtagtgttattatcgttatcatcgaagcaggaacaggttcctgtatggacttcgactttatactcccccgcagatctttccacttttatcggaccttcgtactcatacagaacctcttcatccaaataaataatgattttcccgaactgttctttcggtatattgatcacaagcggtttaggagacgtttctatttcaggttcctcttttgtttctgccgtatgatctgccggcaatgcaataaccgcaactgcagttgtgcaggtcaaaataagagcagcggccagaatcgaaagaagagcctttttgatttttttcatcgtaacaccttccaaaaatgccccggacaatgccggggctcatttcaattattctgattttcctgagaaccatttacctttccgtcatccagaagatcttttactccaataaaccacttctgaataactttcttcagtgcattttcaggaataagtacctgtaaccacttaggcaaaagacctcgtgcctgctggataacccactcaaatttctgttttccagctccggattcattatacatgtgctcagctttcaggatcagctgatatacatctgcacgtattccgtctaatcctttcgccttcatgtactgaatcgcaatcacaatggttacaatgacgagaacaaggataaccaaaatcaggatcggtaatggtacctgtttcaaaaagtttaataattccataaaaattcctccttacaaaaaaatcctttcatctgtgcatttctgatacactcttttgatgtttttaattgcaaatactgctttgttattcgggaaatctggatgagaggcacaatatagctcatattttgtaatatcatccataatctggtcgaaatgctctttcgtgtgtttctcatcatgccggatttcatcatcaaaccttaaaatcctatatctccatgtataggccattccctcactgcttgatttttttaaatcaccgattgaaccattcatccggtcaatcttattttccagctttctgattgactcactaagttcactccgtatgtctatgctctgctgcctccattccggataacggtcaatctgttccaatgctttttgaagcattttttctttttcctcgtacagctcatatgcacttttaatctttctatatactttgcgaattaccgttttgtatataaaaatagtggctcctccaatgagaaaccacttgtatatactcaatccgaatattgtatatgagccaaataattctaaaaaagcatccatcatttatctctcccatatttgatgtgttactgggtgcggtctgtctctcggattgttcatagcaatccctccattaaaaaaagagcctgttcagctctttaaaagtctccttgtttcatttcttcatattgacttaatgcctctttcgcaaggttttcatcctcaatatcctgcggtgtttcttcttggaaaaatccatacaggcttctaatatgactgagttcgttcgcctgcttcttcacaatctgtgtcagccggtatataacttcttcctgcttttccgcaaggtccatatatgtgtttaaaatttcaaggagatcggtatcgtgttcttgcattactgcatcctccaaatataatgtggtttctcttccccgaaaatccaatatctcagataatcatcaaggataatcgccggagcagatagtacataccacagcaaagtgaatggtaagcagatctggccgaggatgttaaacggcatattgctgtagtcccatattccaagaccgagccacacattcagaatcagaccgcttgtaaactctacggccgttatgattatgctgcatatgagcatctgtttccatattacagtatcccacttaaacacttcattgagcagaccacagagaatgaaacatacgcctccgacgccgatcatcgcccaatggctgtatcctctccaaagtgtttcaatgcagaaataaataatgccgcctacgatgaacaggaagagatactttaataacgccttcatactatgctccaatctggctcaaatagtcggaaaggacttccgactgatactcctccggaatatctgcaccataaaaaagtgccgccatttcagaagccttggtcaaattatcaagccaaacgaacatactattgcagtatgtggtgttgtaggtaacaaacgccatggcagtagcaatgattttctgcatatctgccgccgggtagtaaacacaaggttttgtacctgtttcatccgcatctctatggtatgcgcatttctcagcaccagcagaaagctctgcctgttttccgaaaaggttcgtctgatcggtactcgtaagagagaaatgctccactccggtgctcagctctacatcgacaccttcataaatagtgtgttcacaggcagctgaaatagcacttctaacaacagaacgataattctcttttgcaaggaaatctgcgtttgctccttcttcaagatctttcagattttcaaaccaaaaatccacatcggcctcaatctcagattccggagcaatctctgcagaagagatcttacaataaacctcatcagcctcatatcctcccggtccttcctcggtttccggtaactcaacctcatttgaacgaatccagatgtccgccgatccgtccggcagaataacataggtaattcttccctgcggaacagggctgttcgttttatgcatataatgtcctccatttctgataatacttatcgcaagtatatggctttcctttttcacttctactcacaatattccttgcgataccaataatttctttccacatgacagatgactggaactgaaaagaatccgtatttttaatccatccatggtatgcaaggagggacatggcataatgtttcgacacagtcctcctatttttaattttctttataagtttagagaattttcttctccctcttaggaaaatgctgtcacgaacaataacctttacacgcttcaacctcttctttgttccgtcatatatgcggtaaaatgcctccatgccgcagaacacaaaccccataaaatcgagatttctgccctttgtttttccttggttcgttttatagcttaccaagaatttctgccatgtaggctttattacgaggcccaggaaatcccttgtgaatgccacaatcatttccattgctttgtgtatatgcttcttgtttcctccgaacaccacgatgtcatccatataaatcatgacatgagaaacgagcctcgttaatttctcttttcctcggcgaacggttttttcaaatagcttttcattgatatagtgatacaggtatgacatataatagttgcaaagatcttttgacaccggggaaccgatgagaataccttttcccaagcagtcattacgtccaagcagctcattcgcatagtcatacaaataaataatcgtatcgaaaagatatagaagcatatcagacttccggagatctctatgtaacagagccttcagtttatcgtgaggcatactcggataacacttttggacgtccgcttttccgcaatacttcgttccttccggatccgaagaaatccatcgttttatgtgcttctttccataagactgccccctgccttttatggaggctacctggtactcaccgatctttgcctcaaacatctcttttgtagcatcccgtataatcgtttcatacagctggaatatcagcttttctatccccaattcccgtttctttccactcaatccatccacaatttccacatactttacaagtggttcattcggagtgaccaagaggatatgatcaacaacggtcctgttccggatattttcggaaatgtctgcagctatacattcaatagtaccttccacaaactccttggaatcattgatacattttcttgatttcgtgttactgattccattgtaatatgcgaataatttcgccacattactcttatccagcctgtcaaggaggaattcgctgatactttcctttacaaaagcaacgtctgatacatcctttcttttacaatacgttttcacaaccagtcctctttctttctgtattcaagggctttcggttttactactaacccccatccatgccctattcgtcacggagccggctgccaggtgcctgacagccgatgctggttcaagaattttaggcattccgcctaagcctgtatagggccgcttcaagagcggcgaaacacactacgaaaatgcaatccatttcagaaatacgggcggcatggttccagttcgcgttggacagggagttgttcaagttcgcgtagaagcggccggcgttagtcccgttgttcaagttgccgccggaaaaccaagccacttgtagtgtgagtccttattatattgttataaatatctgaggggagagcccctcttgcttcgcaattcaccccctacgctgtcgccttttgggcgcagcgtccagaagcagaaagacgggcggcacggtaccagtgcgcggtggacagggaggcgcccaagtacgcgtagaagcggccggcgtaaggcccgttgtccaagacgccgccggaaaaccaagcccttgtcgtatccgaaacttgatcaagtttttctgtgtactgtccatctgcatatccagtcgaacttgtcgcatccacttccaccccgtgacgaacagacggattatcaggatcatatccgagtttactgatatatttatatgactgctgcgtatcagcaacagaatatccaacagctatataatcagatgtaactgatgttgccaatttggtgcagtcataacaaatataaggaatcatcacatggtttgtgattttcataatcacattcgaaatgagttcccagaatccaattgataattcaaccccaaacagtatatatgggaatttcccatttgtattacttacaggagatccgcatgaagccaaaacattatcgcacgcaccagtcatccaaggcattgtactgatatacgtcggacattcaacgtcactaacaattgtcgatgcagtagaaaacttctggccactgttatcaacattcacagcactattttctccatcgtaatcttcaatggatacgatctttacacgattcgcttttgcgtgcattcccgactgtccacgatcgatatttggcgttccggaagttaatgcagtagcatttccaatagaaacaacggagccaacaacaagagtcgccgcctgtgcttttgagatgataattctctcaacatcggattcctgtatggtcgctgcatactgataataataggaagtacatcctgccattacagactgtgaattccttgtggcaaacgcaaccaggaaaaggttgtccatgtgagatttatcctgtgcagtagttccgcaatactgtgttcccttttcatgaaatcttgtaagagcagcgttgtggccctgattatgttctgcatttcttccggtaatggaagacgccactccgtcatcattatctgctgccatgtatttagccatggccacaaacggtcgaactgttccatccggtctgattgccgctccttccgggaaagaaccgggaaatttttcatcagagattaccaggttttctccgtttgcgtcgatgctcaactcaatccactgtgtcaggaacaggatatacacatcgtagtcttctctagagaattcattgtcaattcctttgatgtactgaactacgaattcaccatccgttcccacagatccatttacttcaagaccgtaaaaaacagactctccctcgaaatcgtttcgattccttacagtgtccgttgatggaatagccacttttccaactgcatcatacagtctggttccttctgaagccgggcttacattgtatgcgttgaaatgaactccataccgttttccggtccttctgaggttcagcaggaaaagtgcctgctcatttttgttcttagcgaatatgctggccgcatctctgagagctacatcattctggatgagctgtccaaacagggcgttgaacatatctgcatgtgcaggatccgttgtctccaacatccgcagctggtcattgaatacagcgccacttatatcaaaattcgacatattctacctccttatgataatcttctattactttttgtgcttaacaagttgcaaaatatcgaaatacgttagaaagtatcttcgcactcgaatacaacctccatatccgaatccttacctttcttcataaaggctttcatggcaaccatatctccatctgcatcataaagaccgatttcagaaatatatgtatttgccaattcgctttctgtgagggtgcatttgtatcggatacaggtatcagacactacctcgtatccatccacttcctttctcagcacctcgctgtgcagagcattctgatccggggaatgcggtacaatcacatcagaagtattcacgccgccggtaccaaacgccattcctacaattttgctaagcggggcaattccagccctcgcctgaagcattttcttttttgctttcgtggtaacagttgttcctgccatcacaattcctcccttccagagttaagtttttttgttccgtccagcatacatactccatcaagaaacatggaatcggccgggttatacatcgttacattgaagatctcctcatgttcaatcacagctctgtttctgattccgcttatttccggcggagaatcctgattcagacaaatacttccgtccagagttttttctccgtcaagtgttatcgtgtagtcagtccaaaggaattttgccctttgtacgtctctaaaatgacctgtgttctgatttatgattggagatactgtatggattgcctttccataaaaaaagctctcctcatgcgatatggaattgcgataggcaacaccaaaaaacggagaccttactgcattcataatgcagctgccatcgagcagatacttgccatcaagacataaatcccaccacgatacagaggcccggtaaaatgctttcgcagaaatatttccatactctccaataccgatcaggcggtttcttaccacatcactcctgaagatctccgtatttttcgcaataatggaaaaataaggtataaaaaacggcgggtgccttgcgtcaagcaggatacttccgtcaagaagttcccgcccgtccaagcaggcgtcccaccatgtaaagtttgtacggatgatgtttttccagaaaaacttctcatccaaaataaattttgcaatcctcacacgcaattcatagaacgtatgcgactgcttaacttcatccaatttctctactgcttttccgaggctgaattctccttctccttcaagataaacaataaacatattcggatggctgattttactgccaggttcgtttatatcaacgacatcaacggtacatccaagaataccgcttatgattttctccattctccacggactcatcggtgcctttaaatctctcttctccaggataattttccgtctttcatcaggagaaaggttttccctgatcggcagcccgtacttttcctcatggtaccgtagtccccatgtggctgtttcgacaaatgcttgtaaaggcaactcatcaatgatcgctctcgcatcgcccatctcttcgcccatgacctggaatatccatttcccgacataagaattatcataaaatccattgccggtaatatagctgagcatcttttttgctgtttcagaagttggaaactgttcaagattcataaacattcccccttaactgaaattcgtgtcgccagttgcagcatactcttcttttccgagaacaatattttcctctttcccgttcataaggaatgtgtcaaaatctgatactcccggaatgtctgtgatgagtgcccggacctgattgtatatcaacattccatctttcttcgcatcgatatactcctgagcgacaagttctttgaactctttcgagatctgctcaatatccgtggtctcatcataaacaagacctgtgcaggtatatgagattgtctttgtttcagcagcttctacaatcagctttgcacaacctgtcggaaggatccttttactcctgtcattcggagatacgatatggtcatagaccgcctgaacaagaaccttgttggccggcgatccatttgaatccacaaggacaagttttacaacacccggattctcttcacttgcaggaataacgatacagtctccaattccagtgacctcttttgcccaccgttcataatcattatcatttccgatgaacgaagctccttctgctttgtattccatatcgatacgttcccacaatgcctcatcactttcttcgtctgttccaccagaaatccaatcttcgttttctacttttgatagacctttgatagtggtaagagaaaaagtaacggtttttgcctttgtattcgattccttaccaggattcacagcagtaacaggcacctttacagtgcccccctccggaatgattaccgtatgatctgctgcatattcaagagaaggactgtcatctgtggatgctgtacaaaatatagatccctccatgataacagttcctgcctctccggtaacggtaacttctccgctggcataaccaggcggtttcctctgcactccggcaaccgaggcgtgaagatccagccattctccccatgcgaactgggggaacatgagcataagcgttcggaccagatggaactgaatcagctccgatttttcaatcgccgtaggcattgtaaaatcataagggaaaccaccgggcatatcatctatgccttcaggaagagcattcatcattctgctttgaatttcctccggcgtgttattgtcaataaactccggcggtgtgaattccattcccactctcatcacctcctatatagttacctgaaattcttcattttctatgccttttacaataaaggaacagctgacattgtctccgttccattcaaaagtaaaacctcgaacatattctgtcctgggatttaccataagggcttcggttatggtcctttccaaagccgactgcaccgcctcctcatccggctcattcaaagcctcgtcaagttcggtgcctatttcatccggatatgcaaggcaggcatatctctgtgtgagagccattttacagcaccacactttataaccttccataccgttgcaagtttccattcggtttttaccgtccagtatgaaatctcctttttccacatcccatgcgaccgtatatcgatactgattatctcgttcttcgctttcctgtatgaattctggagattcttctaccgggaataaagcattttcagacgccataaataccacctccactaaagcgaacttgcagatactatgacgtctacaacaaccgcttcactctgtatccacgccacaagcactctgtctccaggtttcagctttggtaccggaatagaatgcgaatgacttccatctccgtactcatgtcctccatgagatccgccagaagtaccaagggacattccgcttatatgtctgcagactgtgtagtcttttttcggaattttcacagggaaagtgtttgttgtaaggctgtaatcagaattgattgagccaaaatcaagaaccagagagctctttgattcatttttcatacgattacttaacgtcctggcaagcttattcgctccggcgtgattatcaaacgccatataaaacacctcctctaatcaaaacttccttcatctacccagccccaaacatgcgtctgtccccagttttctgtcacaagatgccatgggtgcgcttttccggaaccgtttttaatagtaatcttagcctttccaggtcctacgctgtatccctgagaaccaggataagaagaaacataatgctttcctccatggaagttgacaatatctccgacattatagtttttcttcggagcagctgtcttcttctcgtattccggataaggaatatgcaggtcaagtgtcataatcttgttatctgcatcatgccggattccgatcacataatagtaaccatctactgttccggccgtaacatgaacaagatctcctttccgtgtccacggaatatccggagcctgtacggtaatctcttcctgaatctctcctttgtcatccaatatttcctgagcagaaaactttgcatcttcaaggctgtcatcttttcctcttgttacaattttttgacgaacgccatattttgttttgccgttcatcgttgcctcaacactacttcttccgtcatcatcttcctggccgatgatcttcacccttgtaatcattccctcagtgcttcttttatgggatattgtttttgtgttatctgcctcaaagtggtaaaccaccttattgttggcatatggaaccacatacactttaccacctcgatcctgaaccacacattttgttccgccctttttatacgcatcatccagaatatccagaatcacatatgcaagactttctgatttgtaagcgagctttgcatgggtttcattcggaccgctgtaagagccgagaggaatctcccagttgtcaaatatcttcataatcgccgactttgttccgattccggaagaataatatatgttgtcttggctttcctgcaaattatacaggttgtcatagcatttcacatcaaaccggtcactgtccgaagaataactcggtttccaggttgtgatataccccctggcaacctcttcatctttttttccatccgtagcaaatattccaacaagacatccgagctttgctatcgaagacagcagaccttgtgtggacttctcattcctcgtggtaaaggagattcgggtggacagttctttttctccctgttcccaccccaaatcatccacataatccttgatgttgtactgctttcctttttcatccattatcactaggcggtactgaacgtttgcaatatcaatcattccagcacctccttagtttggaatggtaagtacggttcccggataaatccaatgtccgcagtcacttccccgccctccacggtacctgttcgccgtagattcaatgacggatttgtttgcatcgtagatcttcttccagttagaaccgctgccaccgtaatattttctggcaatggaccaaaggttgtctcccgattttacggtatatgtacctttgtttgcaggcgccgccggagcaggtctggtattcgttttctttacaaatttgacaatcttcaactcatcagtggtatagatcttcagatacttataccggatgaactcaatcttgtactctttgtttccgaatcctcctacttcctcacaggtaaaggaactgatcgtaacatcgatattgatattcgttccagtcaccatcagcctgagtacggtgcccttttcctgccagttttgtaacgttttttcgcattcagaaggttttacccatgttttcacaatagattccttcttctttgcttcaccaaaaaagacaccttcccacgaaatcgtagttggtgtcattccttttggaattttaatagtccccattgatagaatgtcgaaggactgataatttgttgagtttttcactctgatacgttccgggaggctaggaaatgtaaaccttctgcctccacttcccgtttcggtaagataaatgtccattccatgcctccttatgcgttcactggcatatttgagaatacttctccgaggcggtctgccagctctccgcccagatcatcagccagctccttgaagtggctctttatgattctcatgatatcctcatcgctctgtccaccgccgcctgaaattacaaactgcggattcacattcacattgagttttacttcttttgttccactttcgccttcatgccgaacacttgtcggaatcggttcagaagtatcgctgtcctcttccgaaatggcctgtattgcattttgtgcggtgtaatcatagtaagtagctgcagatgcaggatttcctatcatgccgccttctgcgtgctgtggaatcccgagtatctgtccggcttgtgcccataactcaagacctctccttcgacgtttactgcctagaggaataattacctctggaccatcttctccccaccatgtcagctctggaccataagagaatcctccatttgcattagaagcaatacttcctgaaacagttgctgatccggatccaccgccgctgaagctgatagtagccgtcggatttgcaagcttatagtttactgtgatcgtaaccgttgttgttgttgtgaaacctgcggcgaaagcactgtttatcgcagctccaacatcactgtaaagtgtagaaatagcaccttggattgttcccatggttgctgtgatagcattcgatattccagttccgaccgctgatgtaactccagagtaatcaagtccctgcacagatcctgcaatgctactctgcagggcagttgcgaatcctgttgtatctatactttctgccgatgacagtgctgccgaaaggcttgtattcaagctggatgccgcctcagtcaaatccactccctctatcgaagaagtaatggaactttgtatgctttcctgaagtccagaaccagactcagacatatcgagcgaagccattgattctccgagttttgcattcagcgtttcccctgctccggaaaggtccacattttcaagagacgtcagcagagaagtctgtaaactatcctgcaatcctgctccggattcagacatatccagcccattcatactttcattgacttttcccataagggtttctccggcaccagacagatcaacattatcaatagatgaattcaccatactgtttacactgtcgctcatgtctatatcggttccggaaagtgcagagctcatctgatcaggcagagaagctgcaacctggctcattaactcggtgatagcggactgcgtttccgcagaaagtccatcaaggtcgagccattgtgaagctgtagaaacatcccagttctccacatcaactcctgccgccatagcattgtgcattgcggttccgagcttttcagctaccgttccttctatatccggtaagattccgtccagctcacttccgaaagcatcagctatcgactgcaattcaaaactctctaccctcacggacaggtcagttatctttgcctgatacccttctgtaagagcctgtaactgtgcatcgaactgctcctgatttatagcaccgctctgtagctgcagattaaggtttgtaagagaaacttccaaagcatcgtcataagactgagccgcctcctgaacgttcgtctggatttcagcaaccagatttgcgaaagaatccgaatcgagggatgcaccagaatatttaatcttcaggctttggaaacttgcttcggtctccgcctggctgatttgattggtaatatccgtaatctgattctgtaaattggtaatctcatcctgctcatccagcgtaataactccgtcttcaagagcaacattgacttttgcatgaagatcttttccaaggctttctatcttggactgcatatctgcatacatggcattcaatccggtagtcatgtcggtttcgttccccggctccacaagcagatctattgcggctttcgcctgatagtgcttgtcctccaggtactgcgatgcactcgagagcatattgtcaacgcctgcgatatactcagatatttcattgtcatcaaacttcattccgagtgacgctttccaattcaacttatccattgtgcttactgagctctggagattcgcaagagaattctgtgcgtcactggccgcacttgaaaatttcgtaaatgcctgttcctgatctccgaagacaatctgctttgcagcatccttaatttcttttacggataatttgatatttccaaagctgtcctgcactttcttagacgccgcctcttgcatcatagaggcaaacctctctgcagatactgttgtgtcattgaatgcgtctttcagcttggaattctcaaaccgggaaccttccagggcatactttgatttctgctccataagctccgctgccgctgccgcttcttctgcggcctgctttgtctcctcgtagtcttctttgaccttatttccgccgaaccagccggcaataccaccgattcctgcaccaattaagcctccgacaaccgttccgagtccaggaataacgctaccgattgcagctcctaaagccgctccgccggcaacgccaccaacttttaatcctgctgatgttccataagccttcttttctgccgcctcatcggatttaattgcatgataagcgtcaattcctccacttatgagtgttgctcctccgacaaccccgcctccggccgctgctgcaccagaagcaataagtccggctcccgtagttgctgtagaaccgattttcagaccaaacataccggcagatgctccaaggcctttcagtcctgttcctgccgctgcagatccgataatagcacttccaagtcctaatccgccttctccacttccgaatatcgtctttccgagtttaactcctttgataccggcacccaaaagaggtgttgcaactttcgcaacaagtgctgcagataaccaggaagacagatctgcgtcaccggtaaatatttttcctgcatttttgaagattccggaaatagcactgccaatagcagattgaatctcagacgcattgaatccacttacgaatccgcttgcgaactgccgccctatagttgcaccctcatcaatcgtagaacctacgtcgattccgagtagtgtaaggattccggccgatattccagatccaagtccttttccaatatcttcagcttttaacattatcttttgttttccggatgaatcccaccattcagaaaacggttcggcaatcagcttatcccatccaatctttatctttccgaataagtcagcatcctgccattccttcgtaccagtaaattcagatattttttcttttgtgtggtccacaaattcatcaatcctatccatggtaagaaggagtgtatcttctatatcaggcattttttctatcatccaatcaagggcatccataagatacggcttaaatctctctccgagagatatttttacaccgtcaagagcagacttaaacaaagtccatttaccggataagttatccagcattgtatctgccatcttcttcgatgctccatctgcatttccgatagcttctgccaatttgttgtagtcttcctcagaagcatttaccagagcaagaagacctgacatggcctcctgtccggccagctgagatgccatctgaaccttctgttcctgagtgagccctgcaaaactctttctgagatctttcataacatcgttcagaggtctcatacttccgtctgtattcgtaatgctcaatccgagcttttcaatagcttctgctgcatctgaaggaggatccgacaatctcgtaaagatagaacggagtgcagtacctgctttttctcctttgataccagcatttgccataagtccgatcgccagtgccgtgtcctcaatgctatatcccatcgcacccgcaacaggagcaacgtattggaatgtctgtcccattttagatacattggtatttgcatttgcggaggcctgcgccaagacgtctgcaaagtgtgtggaatcggatgctttcaggttgaaagcggtaagtgcgtcagtaacaatatctgatgtggttccgagatcttctccgctggctgctgccaggttcatgataccttcgataccactcatcatgtctgaggctttccatcccgccatagccatgtagttaaaggcctccgcgctctgtgccgctgtaaacttcgtggtggcacccatttgctttgctttttctgtaagctgtgtaaattcttctccagtggctccggaaatagcctttacctggctcatagcagcttcaaactctgcatacgtctttacggtactggcaatgcccgcgccagccgatatggtaactcctgcggctacaagcgggcttttcaagagtccgaatactctttttacaggtgaagtaacaaggtcaactgctttcagagtcactcgccaagccttactgctcaggctcttaacgtatgtaatcgcctgctttacggtaggagtgattttatcctttgcctcaaggagtatctgccacttctgctttgtcacagaaccgagtgatttttcaaacccggaggctttcttcgagacattatccatgctttttccgagtgatttttcaaatccagaagcacttttcgatgcactgtccatactcttctgagcatttttcgccgcattatccaagtcttccatcttcgccgtcacactaccgagcgccggatcagtcttatcctgtgtttcaatagggatctcaatctttatgaccttagccgccatttgccgcacctcccttctcatcgtcttcaaggcgaaccatcatagacgcaaacataaacgcccttactcccggtgtcttggaataaacctcatccggtgttattccggtccgctggaagatctgatgtaaaagcgttactttaccgccggcgcgaatcagttttttgtaacatcttcaagattgttttccacttcttcgatattctcagaattgaatccactcatcttattgatttcatcaataatgcggtctttttcaccgccgagcagaacagcctcgataacatccagagcggttacgatctggtgtccctgagcaatcagtccattccatacctgcttgttgtcccacagcttatttctgtcttcctcaacagtcgcatggtaaatgagggaagaacggaacttcgcattgtcagtttcctctgcgaatttgactccgatctgtttgttacgaacatacttcgtatgctttttgcggctcttgttcgcctcttcctctccaagagcgtggatccggaatgagaagaacagctttccgcctcttacgatgtcaatctgagatacttcctctgatttataagctgcagctgacagcattccagcgataaagtcatcttctttcactctgagctggttctttgtttcctctgcagagaaagtttcctctcttacttcttcctcaatgttttcttccggttttccgtttacgcttgttaatttcgccatgattcttcctccttaaaaataatggggcgattctctcgccccacctgtaaacatattgattaaatagaaagttccttctgcagatccggttttccgtttacgaagaaactccagttacgtttgatcacatctccgtttgctacattctgaagatcgatgtctccggacgggatgcattctctgtaaaccacacgttcttctgaaccgttaagaccgatcagtacgccctggaatacaaactgcggtgtaacacctgttttcatggattccattaaggtcttgaacatatcaatatcctcaatgacgatctcagttacagtaatagtgattccataggaatcggatgtctcatgttcctgcggatctccaagcgggcggtacttaacattgttgtaagtagctttggatgcaaatgtttccatgctggcaaggagagttccgtctccgtcatacaggcccgcatctttgccggtacgggcgtggcgtgcatcagatgatgctctttcattgattgccattgtctaatcctccttctttattcatctgttctgctgctgaactggaatttatatgtcaggtaaatgtgttcgatggaatccttgtcgattacggaaatatcgaaatatgcgtaatctccatcagatgtatagagggtattctcggtaacagtaccggacaccagttttccttcatttaccatggcattaacgataccctgcagctggcttacaaccgttgctcttccgttggtatcgttgtccacttttccgatcaggctgtctgcctggtcattgcagcgagtaataagctcatatctggtttttgttctgcggattttcttccatccgtcatcctgattgtcagacggagttaccagcgtgttgatcgcactgtcaatccagatctgtcccgtggtgttcgtgctcagtacgatacatccctttttctcagcattggtaatctgagtaggagtcagcacatccacaagttttgtgaatccgctgattacagaatgagtaagggatttattggaaggacacgcagcaatcagaccggcaattctggccgcaaccagataaccttccactttttctccggattcttctacagacgcattgacaacgtagtgcatcttttcactgttgaatccggcggcgtgatccattctgtcatccagagaaaccgtatttttctcagcaacaatggcaagtccgagctgtcccgcattgaagatacggtcaatgaaagaagcgaggagcaggtgcacagcagtttcctcagtatccacgcaagccgtattaaagcggtatgcttctgccgctgaaaatgcagtactgtaatcttctgtagatactgttggatctgttccaggggtaaatgctgtgatttctgtttcagcaagaactcctgttgcactgtccaagatctcgcatgcaaagttctgagagttcacgaatgctgctgccagattcttaacctcgtcttcctcttctcctgcggcaaattcgaacttctcaaattcttttgtgccggcatagataatgcactccttcagagaagtatcagaaagtttctctctaacctcgatagagaacgcctttgttcccggatgcttcgctgtgatggacagtgcgtccttggccggaggcacatctcctgcggtcttcagttttgtattcgcaacagttccgccttttccaactctacagcacagggctttctttacccctgccgccagaacttcacgaatggcatccgttgttcctgctgtaccgaatactttttcgtatccatctccaggtgcgatctcaaccacttcgttcagtggtccgaaatcagctttaaagaaaacagccgttgtaccgtcatcagcaccggcgagctggtttcctcctactttctgaatattgaaataggttcccgggcgaattttggtttcgccgataataaatgttccagccattatttgacctccttctgcaagaatttctttactaattcttccgtttctttgatggtcgcttctttcttaccgaagtatttgagtgcagcaaccacacactcttcctttgtgttaaagcgatgagccgcctttgcgagctcttccgcaggatacagaatgcctttaggctctttcttttccgcagtctgctgtggagcagctttggccataggctctttcttttctgccattgctttccctccttacatagtgataatgctttcgatcgcatgcggtttttccttgtatttcaggactccaaaccgcccagttacatatagctgcccctgtttcaggtaatctgcctgtttgtcgatctgaacctctgatatattcattggggagttatccagaaggataattttctcgtcaacggagattttctgcatgactgctgccagcattttcaggttcattgccttgtcagggcataaaagatggactgccattctgcagtccatccatgtaacaatattcatgttgtgtccagtcgccttatccatagtgacaaggcgactgtaaaagatcggtgtaacggatgcctcggtaaactctccgaccggatccacgccaagcacaatcgaatcggggtatagttttttaatatacctcgaaagtgcaacaatcggatctggatccgtggtctcttgagcggagtattccataatgtcaaaagtaacatcctgtccgataacattcgttccttcaatcgaaaaaggatctgttctcgcccatgcaaaactgtacggtcctccgtcttccggtgaaataagcaaatccctgaagcaggttttcaccagtgattcaatctctaaaatgaccatagacgtgcgttccgtatagatggtgatagttaatgagcctacgcttgaacgttcctcatttgcctgcatatcgaggacgatattgagccttgggtactgcgttttcccttcccatccgtcctgcttatcatccggagcttcagtgtcgaagacagccgggtgtccggcgtattttgcaagcaggcctccaatatctttcgcatggacaagcctcttataaatcagctgtttcaggttcattggttcctccttccggatatgtgactatcgtctccatatcgtttgtataacggacttcccagtctcctttcgcaacctcttctgcccgtaaaaaaaagtgatttgtgacatttccgatctttggcggatactgcacaatcacttcatcttcacttgctgttgtaacaaaccctttttctccattctcccatgttttatgcttcgcatagaccagggttcctctccgaatttcttcggtgttaaacttttctgtaggttcttttacgattaacattccctacctccttaaaaatctgcgaaaatagcatcaacttccggctgtacatcctcaagaattggatcaacaaatggtcttgccgccattttctttgttccgtcttgcagataaccggcgtaatgagcctttgcatcagcataagctacaatcgaaacgccaccgccggaaccgccattgttgcggacaccagttttccatgccctccgcagaaatccactccgaactccaggaggacttcccggaggagatggacttggatttgtcaatacttctatgacgctgtttcgcattgcattggataccctgaatgctttctgcatggtcttatgatttgtttccctgacggattcctgaacagcctttttgatagcctctggtgcttctcccggtgtcatctcaaatcattcctttcctctgcataatagatggtggcaattcccaacgctcctgtatcatcaaccagaaggatgaggaaataccgatcatccattgccaacaggtctcctttctttgcaacaggttctcctttgcttacaatcgtatgcgtaagagagtgctgatcctgattccataaatgtttcttccggtcactctggttcttatcagcatccgcaaggacgccacttaccagaagaccggtgtccacatagcctgaataaggtgttccggtatcagatatatcagtcttttttcgtttcacaatgaaatctttttcaagattccctggtcggagatacatcatattaacctccctctttttcgtgggacatcatgcctgtatagaaatacggtggttttccgcatcctccctgtgctgatatggcgccgacagaaaggcaggatttcgagagatcttttttcaatttctcatactcttcctgccacaacttcgcccgagccccaaactgaaatgaaagtggacctgttgcggtatcaggctcataagaaaatctccggaaaatagattcgatacatgcaagtttcgctcttttccagttactgtgcatcttcagaatcgcattgtactcttcatcagtcaaagcacaggttttctctttgccctctaccatggtatctccgagctggaatctcatgaagtccttcccctcttcttccagctttgcaggatcataactgtatgtaccagccattattcctcacctgcactttcctcctctggagcgtcatcttcttccggtgcctcttcaagtcctattgccacggattctgtaaggtccttgatagcctttctggaatcacaggcattaagcaggataagcacattttcatccgtgagccctttaatagcctctttcgcatcgtttgtgctcatctgcataatttcaatagcctgggacaactgttcctcattgaggggcaaagacatggtttcgcctttctgccgaatcggcatttcaaacataacctgcccaacagtcgctaccatgtctgcaagttcctctttcggaatatctccgccgtccgtagcaatagcgataacgcccatcttctcctgcatctttggattggtgactaactcggccggtacttcctcgccgatgaaaaacttgttacctccaaatgagcagggcttctgtgcaattaacctcataagctacctccatttcttagactgcatctttgaagaacattgccagatcgtcagcggtctttctcatatcgaaagccatgagtccttcaacatattcggaatgtgttccgttctctcccaggtaattcaggattggaagaatctgaccgtttccaagcatatcccatgcgaagatgtaaccagcagacggttcatcaatagcaggagaattggtagcataggaaagcaggaatgcatccggatctccgataaactgcatatctgcgtcagctcccatcgcagctttgtttgcgatagatctgaggacaaccagcttctctactccaaacagctctgccagaacattttctgtaacagaagccggattcgcagtagttccaccgtatttaactctctccagaatcgcctgatggtttttaagctcattgaacacatttgctccaagagcaaggcggttcggtgtgcggccggtgctttcgtgcatggcagtttttctctcatcgatgaatttaatcggatcagagttaccattggaaaacttgataaactgttttccggatacagttgtgctgtctacaccgctgtactcgtcattccatgctcctgctttgaagaacttatctgcaaacagcatatcctgatggatatttgcctgttctgcaatcgtttttgttctctgctgcttcggatcacggatagccggtcccattcttctctgaagatctgtctggcgaatctggtcgatacccataatcatctggtctacctgacagttgtatgtgtcagtgtgttcagatactacagcaggagcaaccttgccataagcaggttttctctgccaattatcacgaagaagatcttctttatcgaaaatatagtagttgtcagaagacaagcctactggacaaatagagaagatcgctcttgcgaaataattcgctgcgttctggtaataagacagtgccatgtttgtaagcgccgtgtgcggtctaaagacgcctttcgcgatttccgcggaaattcctgatggtgtatttctcatttacttttacctcctaaaatttagtcaacgccgcctgcagctgcggctttctgatattttgcaatctggattttgcaataaccgtttgcactggcaccactaagagcaacgccaagaacataatctcctgctgccgcgactgctgccagtccgtttgctccacaggccacttcctgtcctttggtaattgttgctcctgccatgacaaatccaatgtcttttacctggatgtcgatatcatcacctttggcaaccttcccagattcggtaccggaaatgtcattgtaaccggactcgataagagcgattcctacaggaatatccgttccggcggtagcaagtaccacatcaccgtttccatcatacttcatgattctgtttctgcagtcggtgattgctgctccggctttctcaacgatagtcggagagttgttcatctgaactccgttaaaattcttacccattcttttatctcctttccttaaattccagcttcttcttcataagctgccatcaggtccatgttgttctcccatgccttcgcaatagcatctgtgaggttcaggttaggatctttctccatgtatccttttgcgatagactcgattttcgcttcagaattgctctttgcaacaggagttccggttcttccatgaccagattttccgatttcctcgaatgttccacctgcttctgccatggaaacagcagaatcgaggataccaatcatatcgttgtatgcagttcctccggcagctttcaggctcttcaaagtaggaacgagatcttccggtttcttgccgataatctcatacttcttggccacttccataagctctctctcttccgcctcgtcagctctcttgcgtaaacgctgaatttcagctgctaccagcgggtgcagtcccttatagatgtcttctccctcttcggaagatgcagatttcttagtcggtttcttaccgcctccgcatcctttttctgtttcttcctcttccatctcgtcctcgttttctccaggttttaccttagatttatcaacgggctcttcctcagtttcgacagcatattttttgatgatcgcatcataggctgctctttcttctgccgtcatttttgatttgtcgattttaagcatgtcttctaattctcctctctgtttttccattgctttctggatgtcagaatctaacttgtccctgaatttcctcatagattcaagttctgaatcatccaatgacttcctgattccgcagagcttaccattggaccagctctcaactgattcggcgataatctcatcaaactctgaaatgctctgttccatcatttcttttgctttttctctttccagatcctcatcatagagaattgactgcagagaagactgcaaagcataacagatactccagatttcatctgcgactttctgccttttaacctctgtcattttatctccaaaggtctgcgaatttcctttctgtacgttcccgtcagcagatggttccgagaaactatcaatttcctcatcattgaatccgaggcttttcccgatcgagtgcataagtcttttgaaaaggcttttttgctctttcatcggatcctgcaccggaaccgctacaacaggattgtcattctggtcttttcgcttaaacagcttgatgtttgctccctggtttgctccttcatcaacgaaatcgacttttgtgacttctaagttttttaatttcttagccaaccttcctacctccttccatggattttttataatacaaaagacagctttcgctgccttccgattatcacttttcatcatcgtcacggtttcttccgcttatcgcacataatgccattacggtaccgccgatgattgctccgaaagataccagagcaaaatcaatcaatattctcattgtcttccaccttaactctctcggcttctccttcgatggaaaacatcggatatgttccgtttttaactttttcccaaacatcatcgtctgtaacgaagaaaccaatccaccagccgacaggcaatgttccttccggaatccccatggctttcatcttctcttcggtaaagacaacgctttcaaccagaacggcgcaatctcctcgctcatgcatctctccaccttcacggtaaagccgtacaaatttgtatgctgcgttttccagttcttccggatcaatcatatcctgctgccagtctacgagctgctctcctgattcatcaatggagatattcgcccatccgaaggcaagccgcttttcatcttcggatttctggattttaaattttcctttcaacacagacgttcctttatctgcactgttatccacattttcagtggttttatccctggacttgtggattccaaggatttcatatactgttttcattgcttatcctccctgacttcaacatatttcagtacacaccggcatctcggatgtgccggaggaacctgtaccattccacattttccaacgtcaaacggttcatccagttccttgctgacgccttccacagcctcacaatacttacacacgctctcctgtcttgctgtaacccaaacctttcgaacatgtcctatgtatcctttcttctgagcctgcttgataccaaaatgagctccctggttatatacctctgccagttcatccaatgcaatcgtctttgcccggtatcggtgctgcttttcagcatacttgagagctttatcccttgccctgcggacaatggtttcctgcttcattttcggatgttcttttctcagctgtgccttgatattgttgtaatatcttaggtttgcctctgcctgccggctattcaaaccaatgcatggtctgataacacgggaaagttcatccggtgacaattcttcccggacagcctttgcagtgaggcgtctgattgcttttttctgctcctgaacggaattggtaacaaaatcagctcctcgctgttcaatccatttcctgattccttcatcagaaggatcaaattcaaaatcggaattcttcaggctatcaagtatcatgttcccgatctggccaacgatgatagcttcttcccaaagcggagccagcttttcctcgacaagaatcgaataatctttcgaccaattctcaaggtcctctttgctcacatctccgtcctcaatcatcttccggatctccttataggtaatcgaagccgcctgatccgcccagaactttgtcagtatcgatattggaacagcctccgtatctgtgatatacctttcaagcatgttcagcagtcgaaggtttccgggagaacggcgttttttcttccctatcggagcaggtgatttaaacaaaaaaaccatattcccaccttaccttccaagccttttcttcgcttcggcagctttcttttcatcctctgcctcgtcttccggctcttccacatcatcctccggaggttcgttcttgttctgctgctttgtcctttcagggttctcctccctagaatccgctgtcctctcaggaagatgtccgatctctcgaacataatcttcaagtccatcatcaggaataagaacaccgattcctgtcatatccttaatgaactgtcctgcctctttgacatttacatcttcaatgtctccgtgagtcatctttggataatctgaaatcccattgaaatgatctccgtttatatcaatcagtgccggaatgccctgattattgaatgtttcgcagattacatcgaggaaagaactgattgcaactgaaaaaagctccgttttatcagagctcaatgcaaaacttcctactttttgatgtccgagcatgataaagtccgccaataccgtcatggcgatctttgtatcatacctgttgataatggcgttcgtatcaaactgccttgccccaccggtgcttaccagttcaaattcaaatccatgtggaagaactaagccttcgtactcatcacgacgaatggattttaccattcccatgagtgctgcattgatttttaccatatcatcgtctttatcatcccaaatatcagttccttcaggagcatggaatactgggagtccagcaaggtctctttcgattcctattgcctctatttcctgaatccttcttttgaagtaccaggaacggtacgcatttctcagtatgcttcttccctccgggttatcctttgcactctcagttctgaagagcattgcctttctgattggaattgtaatcgttccaaagtccggcggtggctgctgcgtcatgccgatcaggttatcgtgctcatcaaattcccattggtaaagcgtatcctgggaacgtatcggcaacttctgccagccaatcagaccgtcagaatacttgctgttcgtcttcctgttcctgctttttcccattcgtcgcttatacacaatttcgtgaaagctccaaccataagtcaggaatgataagatctccgaaatggtatctgtccatgtggtactcatatcattcatgcagctttccacaaactctgccgcctcacggtctatcgccgtatcacctccgggctcaatgttccatttggtatgacggatgagcattttaatagcaaaaaggatggcgccgactgtatcatcattgtccgccatctcgcgatacgtctttatgccttttatgccctgcagttcccgaagaaattcctcatagaaaactccaccataccgcttctggcctatacgaccaatctctgccatgggttttccctcctttcactatctttttttggtcttttcaaccttttcatcaattgatatttccggtttcttaaagttcttgttgatataatcgatcagaactttgcttgccggattctgtttctggataccatctgccagatttctaaggcttaccacgatcaatgcggcgtcatctgccggataaccgttcagagcttcgagaatctgattggaataatgatccagacctttgattatagtctgctgagctcccggtgtatcgccattctgaatctgacgattcccttttgtgacaaatccttctctttttctaaagatacccattcaaacaacctcctatctgtttttccagtagctgctctttccaaggccatcagtattcgcctgattcggagcacttccggtgtacttcttgatttttcctaagtaaacagaaagcgccgcagcatctccacggtccggggaatccaatcccctctttttcatttcctttttgctctcaagctccagctttccattgctggcaaggaaatattttcgtgaagaaagctgtgcaaatgtctctgaatcctcttcaatctcaatctcctggttctccatgaggtcctttagtacagcccacatatgggttgtcaggttgttgtaatgctccgctgcatctttcccggcctttgtgtccgtttcaatcttctcagcggcatttataggcaccacatacagcctgctcagtttatcttcccgttttacttccctaagtcggtcagttactccacctccaagaccggtatcatcaatattgacgtatatcctcccgtggtagtccggaaattctttgattgctttcttatactgcctgacaatatctccaaccgttctcatcagatcttgacctcttcgctttgctacgattttcaatttccctctggcattgcggtagataatcgtttcatcatctccgaaacgtgccacatcgacaccgaaaatgatatatggcagtaattttccatcatccagttcaaacagcctgctgccacactgctctatgatagataatgcgataaaaacgtcgtcctcctgattcgggaattctccccgcacacggacacggaccacattggattcccacccgtatttctttatcagagattcgatattctctttgtttgttctcttgctgtctgcagacgatacagtatggcacttataaagtgccctgtctcttgtgtggctgtcatagaatgttccggttgtcttcgtcgggtttccacacatgagcagtttattattttctcctgataaggtaccaagaatagcctccataatcggatcggcgacaccagacgcctcatccacgataaaaagcatattatcttcatgaaaaccttgcatattctctggctttgtagcagtcctagcaacgccaaaccaacgcttttcattgccaaccatataaacatatgtcttggtccatttgagtatttgagagagcaacggagacttgctcatccacttcgagatctcagaccaaagaacatcgtgcaactgctgttttgtaggagctgtcgctacgatacggggatacggaaagcaggtgataaaccacaggaacacagcggcctccaaaccggtcttaccaacaccctggccagatttgatactgaccttcgggttgtgcgccaagtccattgccgcctctgcctgccattcatcaggttcaaactgcaatacttcccggaaataaatgacaggattatctctccatattggtatgctttcatcaaggaagtccgacaaccagtccatattactgtccatcctgttccctccttgactttatgacgctatcagcccaggcacgaaccaattcgttccctttgctttctcctgctgccttttctttctcaagtctgagttttgccagagcgtcaacggctttcgttttacagctctgtacggaggtcagctctttttcaagccttgccacaagatctgctgtcgatgcggtagaagtctgcaagtcataagattctccaggaagacgttcattcttcattaccttttcctggattctctcctcatacagttctttttcctcatcgtctttgaaggttctctttttctcaaaccttatcgctccggcaacatacacgcctccctttgaatcccggtacttattgattgctttcataagccggcgttcccggactgtgtaaagagcgatctgatttatcaagatttcctcttcatcctgtggcatggattctatgagctctcgctcatcctcatccagcgtgtcccaatatacagcagagtaccctccatgcttcagagcgttctgagttcctttcggcgctccatgcccttttgcattctgtttccccttgctgtttttgttcccaggctgtcctcctcttttgcgaacgctcgctttatctttttgcgaacgctcgccttgtttttttttactgtttccatcccagttctgggtggacttccacctacggacagttccttcaggcttgccaagtttcttagcaatatcaaccagagccataccgtcatggaacatcttttccgcctcaatgctatctggacttcttgctctcggcaacgccatcacctcgctttccgcattttattcggacacaagtaaggcggtcagagcactcgcccgaaccgccgttctgtgttctatatgttgtataacagtttttaaaatcagatttttgtaacaaattccgcttttgaaaaacctccaacatcctttgtcatcatattgaggaagtcctcttttgagaagtctgataacctgaagatctcttccggtttcataccaagctgctttccgatttcttctatcgtttttccctcattcatgagttcttttacgattttcttcatcggttcaagcagatgtgtacctcttgccctgttatgagtaacggtaccgtaaatatcctccgaatgttctttgtgatcaacgataaccaccggaacgtgaccatccaacatggaaaccagaggttcctgtccggctacagtccatctgtggaatccgtcaataatcgtaaaatcagggcgaaccacaatcggaagagtccagccattcgtaagaattgactgtgtaagcagtttcaggttttctttggataccttattcgggttgtagtcattcggtttcagcttgcttctcggtacccactgcagggtagataacggtgctgtcaatttattgtccatgctttgaatcctccattttcttcgctttgctgatgtatttaccataaattctgtgataaagcgcccggaaggttctcatcttcggatctcccgagatgagtccctcgtatatgtgcttaaagtcctctgcagtagcaatggttgacacctgcatgaagaaattcctgtatcgttctgcgatatgccgcttatgcggagtatcgaagaacacatccatatttgcgaacatggtaagcaattccttcttgtaatctttggtatcagaacctttttccatctgccggcggccttttgtgctcctgccgaacatctcgctgtcccaatacagggcagccagataagcattcggctctcttctgatgattcgttccatcagatctgtgtaatattcattcatttttaccagcgagcgagctgtatctacagaaaagaactgcgaaaccctaagctgctgctttgaagaaccggactgccataaatacagatatatttccggtatgtcaacatgttcccgtttcaggaacagccagacatcattatttgtccagtcatatatcggaaatacctgccttttgtttgtcatggttcttccggcttttgtcattgaggcgatattctgtaatcgctgcaatgattccgccgttcttattcctacgagagttattccggaagtgcataccctcggaagaaaatcctggtacgcatccactctcggctttaacagcttatggttcctaatcgaaaatggaggtggctgtcttacccacacatcctgttttgttgagtcccagcatataaacgtctcatcatttgataaggcgttgaaacagttgaaatgttttacttctacgcagtaccattcaaatttggctcccatcatcataaagatacggcgccacttctttgtcatatcttccatgcaagggaagatcgcctcttcatcaatgaactgcacagtcagctgtttcatgtctatctctcctcggtttgccagatttaccagaagctgtgctacacacaggctgtctttcccgccactaaaagaaaagaataccggcaatccgtttcggaagacgttctttattctgatttcggctgctgttacgacatctatgctggactcacatcgttttacagccatatctgttcaccgcatttcgggcagattacaaagcgtctggtttctgctgattccggactctccatcgtggcggactgcccgccctgctgcggcaaatcagtttgcacaatagctttcccctcttctgaagcggattccagttctttctgctcccgtttttcgttcgcttctttgatctgctgaatctcctcttcgtccaaggttccatattctgaaattttctcagtgacctcatcggcgtctgccaccatctgttttaagatttcctcatcgaatccaggaatatccaaatctccgttcaattcttcgaggaactcattcagtgtgtcgaggttctcaattcccagggaaaagatcttgttatcggcaatcatcagttttttcttctgtgattccgtcaggtcctcatatttatagacgagtgcctgttcctctcccatacgcagtaatgtctcatacaatccatttcctgcgaggattgtgtttttctcatcgacaacgatcggccggatctgtccaaacatcctcacacttcgctcaaattcttcaagctgcttttccgtatggatccttatgttccgttccggccggacaagttcactgagtttcaatgttaattgtttcattggtttctcctccaaaattattctgaaggagcaatttgttttactgtcatgtttatcgcatttcccgggagaactgcaattcttccggtgttccagcagttacttaccgttcttttccagaaactctctggcactcggtatcgtcttcgccgcatcgataacaatcctgccgtcaatttcaaatacttctttccacccgttttccacggatccggtccattgtcttgccggccacgggtgtgttccgcaggaatacccattctgccactcataaataggcggaacaggtactttgtgataatggataaatgcgagtattgcttcatggctccagtccgaaagcgggctgtatcttgtaacgccctttccatccgtatagatgtttgagcctttaccgacataatttccgtctgctctccgtcttcctagtagcagcatatccagatcgtgtgtcttataataccttgcctgccccctgtgctgtaccatgtggaaccattgagccgctacattgcttttctgcgggaatagcatattctggtgtttcaataaccaatccatgttctgaccggtattgatgatttccagcttttccggtttatgggattcaacccactccataaacgccggatattccagatcgcatactgccataaggcaatcgtggattcctgccatttcgcataccctttcaagcacgagggaatctttccctccgctccatgcgaacgctgctttctttccttcggtctgttccagaatctcagatactgtctgatcaacaagtgtatccagttcttctttctttaccagatcttcaatgtgctgcattgcatttatccaatcttcatttctgatactctgttttctacccaatactttttccatgaactttcctccacgcactcataagcacagctacaaatcccgccagcaggacggttaataagctacctattgttttatactccggtatatcaaaaacagtgccacaggcgaaaataggaagccctacggcaaaggaagtgatgattccagccaccaccccgttgctcgttagcttaacctttaacagcgtgagcattgtcgggagcatcgttgtcgctctcagtgttccatagaacaggaacatatgcgttacggtaagtcccggaatattggaaattaaaatgccggcaatcagcaatgcgaccatggccagcttggaaaccctgattttatctgcatcttttaatttgccgataactttcaggtccgttgtcagtgaagcaatcgcacacagattgctgtccacggtggataacaatcctgatatgagcatgaacataaacggtacaattacccatgcagggaaaagtgcctgtatcaactcaaaatttaccattcctgtatctttcggcataaatcctatgcctgccgcaataaatccaaggattcccatggaaagcggtaccactgcaaacagaacagctccgagcgaaaacgcccttccaatcttcttatcactgatagaaaaagctctctgccaaaagcattgatctccgaacggtccagcaaacagccctatcgctgtaggtaatccgaatcccaggaatacctgcagtccgttctttgaaaacagatctccgaactctccggtaattccggacagttggattgatgacattcccccatttgatttcaacgcccacggaacgaatattgcacacgccagaagaaggaatatcatctgaatagcatccgtaagtacagacgcctttatcccggatatttgcgaatatgaaaaagcgatgactgccagtacaatcgtcattacccaaagcggcaatccggtagccacgctgagtatcttgccccctgcaaggagctgtactgcagtggaaaggaccgtaagcattgtcagctggaagagatatactccttttactttctccgatctgtacttttcatgcatatacccggacaatgtaatgccattcggcatttccttccggatccgctttgcaaacggtatgaaaatgagcaggcagagaatattcggtaccagaaaccaaaataaccccggaacgccattcaaatatgctttctcagcagatgtaaataacgccggggcccaaatccatgtggcagcaatgctcatcgcagagctgacggttcccatattacggttcccaacataaaagctgtccgaatccttatccctctttgcaaaaactatggtggctacaatcataaggaccgcatatgccaccaacaccatgattccattcatcttttctctcctttgtttgatgtaagaagcattttcttcctttcttgcatctcctttcccggaatgaatgaaaaaagccaccggttctcttccggtggctcatggctcttgataagattttactcccatatcatactcgatttccgttattaagtcaatattaacttaacggtttccgttattcctattttcaagaagaaaacttcaagccgttaatgccaaaaaacagggcagacaggcgctcttccgctgcctttatatcatcatagatcgtgaccttactaacaccgaatctttttgataattccggaacactcgccgcctccttcgtcatgtacatggccttcacaaccttatactgcctcttctctttttctccacatttactgcaaaatacccggtacacatccagcattttatcaacatgagcaattataatgctcgtcctttctgctgattccttaatggaattcacgattactccgtcgctgcctttcatggacatgaggtcctccatgacctctgcggcgcttttctcttctctcgtctttgaatataccgcttttgagcatgattccttcagcattctataatttctaagcaatagccttgtgttgtgcagtcggcgatcttttaattctttctgctcttttcggtatgctttctccatagtctcagccgccacagacgccccggccagagctgccttcgcaatcatggattcgatttcctccttcgtcaatgctacgaattcaactctatctttcatatccatgtcttcatcctccaaatctaaatattctcgtgaatcttcctgatcacgttttccttatactcctctttttcctgctctgtcatgccagcagaaaactccggaacactaagagccgcatcaatcgcttctctggtaccgcactccgggcagataagtgtttcattatccgttctggaaagtgcaggaactccgtcatattcttttctgcacagcgggcacactctcttattctggtttttcttttcttccatcgaacataccaagcctttctccaagctgcagacatcccatgactatcatttcgaggtctcttccagaaatatgacacatggtaaaatcaagtgttgcttctccggattctgtgtcctcttttataccacacatgaaacctttatgtatggtattctcttctccattatcatagtgtatcactattttttcaatatttttttcttccattattcagctttctccttcctgtatggacagtatttccaaacacaattaacctcatattgatgctcattatactttttgttgttgcaagttccatttccgctggaatatgcacatgtcctgcaatatccctcatgagtaggaaacagtattatcttagccattgctattcacctctcccgtatccggaagatattccgggaagtcgaatatgttcatttgtccggaaatctcgtcttcatctccaaccttggcatttgaatccggcggttctcctgttatctgcgaccagcactcaggtccgtaccctctggccatactctccggatccgtcaacttcttaccgcatttctggcatttcgtgaacattttacacctccagaccgtttttcggacatatatggcaatcattattcgctgctccaaagcatccattgcacctatccttttcctcaatgttttcccagcagacacaagtatcatccagattcctgaaatctcctctgtattcactatccccattgcagcatacgccttcaaactccgcataccatttacaggtacagcagtatttcttttcttcgcttcttatgcaatcatccaaaacatccatcactctccacttttaatatgctttttttgcctcgctcaaactagccattctccgttttgccaaatcatcaaagaaagtctcgttcgcattagtcactttatagcatggttctgctccaaagaatacgatataggaatccgttagaagctcatgcatcactgttgtgtattcctttgtcattgcacatcctccaatagctggacttccatctttcaaaacatcaaagccggtgcatgtacttccccacatctgagaaaaaacaatagcttcaaactccaccgatctatacttattttcttttcgctttttatctacctcttctgtgaactcactatcctttgacaacataactcttgctttaaattccaaaagttccaaatttggatatttcgcatgcattaaactcatctgtcattttcctccttcatccgttcttcgagtatctccaggtttctcatagcaatatgtatctcttccggtgtcaatccggtattctcatattcagccagtctttcaacaagatctgctttacttctcccggaccagtatcctgtactcagtccgtttgcaagtttatgtgttaatctcttcatttttccctccagaatccgatgaatcagatttttctgatttctttttaccgtttcctccatatttgacagccaatgccattgcatcctctccaatatcatcattgctattttttccgttcattttcttctggcatctttcataggctttttcgtagttgtaacctatttggccggataatctgtatgccatttttgaaaacttatccctgtaataatcccaggttggtccttctttgttcgcaatcagctttaaatagtccttcaatacgcagattattaaaaccatatccccgtatgagcaggaaactgtaaagtcgcttaacgtctttatgtttatgcacttttcaatccatacctgcttttccgcatcatctgctatctctttctcaacttcatccaggaaagaaaacaaaaataaaagatgttcatccattttatctacccccaaggaacgtattaagcattttctccttccattccggaatattctctttgctgattctatcgaactgccgatgcagtttgtaatttatttcatcagaaaccttttccgctgattcatgctgcataatcaactgcataagcattatgaacacatcggcaacctcggaccaagtattatcagtcagaaatacaagatcttcaaaatcaaatggattcggtgctttttccaactcatccagaagttctctcagttcttccttcgcctttaaaagctggcttcttttgctgtaatgaaccgaaagcgtcctgattctttccaatgacggctcatccagtattttgtatttctcaacaggtttcatgtcactcattttctatactcctcctatctgtattcttttcctgtatgcttgtccttcagtacgattcttccgacaacctcaaatccggcaagctcagcagtattcttcataatcggtatgagattgctgataactgaaagccgatccgcttctcttttatgttcttctctacgaatattcccaaacgcagcacccggtgtaggatctacatatccttccccatttttattcattatttatcattcctttctcttgcagctgatctaaacatcataagcagcatttctgatacaggtctttctctatcttttctggcagatttttttacagatttcaaatcgtaccattctcccctgtagtttttcttttccggtaccaacacccctactttgtatggtatctcgtctttcactttttcgtacacatcttccggcattacataataattaaagtctccaatgaagttatgaccgttttttgaatggaagtcctctaccgatgactttacctcatagcagtaaaaatctcctttttcaattccggaaactgtattatttaccggcttaaatttcatatagtccactcgaaccgcattgcttgtagcgtaatcaaaagtcacttcttttgcccaatatatcctcggatctccgtgtgggtttatgtacatctctgtcgatattgatagcatcatcgtaatctctggtctattgctcattattcatttcctcattcatataccgttattgtattttcacttcaatagtcctcgattttacatttctattttttctaagaacaaaaacctcttcgagtacaattttaacttctccgatcggagagcattcttcataagatctttcaatattccaatccatgaaccctcctaacattcttggtgtttgttcagtcatgtcgcatctataatcccgaaccatatatgcatgttctcccgatacgaatacgactggttgcttttcgttaatcaatccaataatttcttctttgctcattctaaataacaaaaacaaatctaaaattcttgtatcgcctttcatatttctcctcctaatgcgtagcattgaagttttcaatcgcccatttgttcccagtagctctaactgcatttcttactctttcctgcggtggaattccttttcttttattctcttgcggcttatttttcaccgcaggagtttcattcttcgttccagtcattatatgtttcctcccttctgactgctctgcagctgatcagtggccagcttgaatgcaagcatatacaaatcaaggatatttgtattttgtttccctatatctccgacaatctcccatacatcagaaaatactttccccaattcatcatatcctttacttcctattcctcgatcttcatcaaaatcttcaaggatatcatttataacatcatcaattgtctcaaagtcaaaccgatcattcataaactcgtcttttacatcatactcatccatcaaatttagaatgtcttcacgcgcctgaccttcgtcatatacatatatctttcgattcatgcaatctatctttccttcaaaatatccaatattatttacaaaatcggaaaatttttcatatgtcatattgctgtaattagtagcaactaattctcctaaatctccagaaatatgtaatctgcaatagtcttcttcaaaaagaaatcgtattctataatgcgaactttccggctccttaaaatccaaaatcttaatatttccataatccgtgaatttcgcaatatggtttttaaaattttctctttgcttttctaaattcatcatgacatctccatttatgtaactactctttcagtcttaccggaagaactagggctttcatgtcagaatcctctgcctcgacaaccattggatttaccggacgggtaagattcagagtgatattgtcacaggtaaaagcctttatggtttccagaaccaatcgggaatcgaatccgatctttatcggatctttgattttctcctgaagagcaactttctcctgataatttgcaatattatccctgatacttactgtaatctcattttcagatatatcaaaaacagccgggctcttttcatccgtacacatctttgcccttgtcattgctccgaccagatcactctttcctacgattgtgtagttatcactctcgcagaacatctgcttatacggaagatacttgccttccagaagtcttgtgtatatcacatatccgtctgttcggaagattgcgctattggcactgtatgatacgttcacatcatcatccattcccatagacaggagttttttcgcagctgctttcggtacaatgattttcagatctgcaatgccatcagccttaattctgtcccacgcgaggacatggccgtcagttgcaaccagatttatgtatccgtcacatccttccagataaattccttccagcataggcttagacggctccttttctgcagctgcgtagataacatgggaaatagcctccatgaagctcttgccaggaagagtaagttcctctcccgattccatatccgtcttactgtagataaagttctcggccgggaatgactgatagctgttcttgattttctccattttgattgttacgacattcttatcatcatggagcagttccacatctccctccggaagattcttgataaggtcaaaagctttcatcgggatgataaaggattctccttctgcgtcctcgcatttgacctgtatcgttatttctccattggcggcgattaaatacccttcttttaccaaaacgcctcccagagcaggatgtacagtatttttctgtactacgcttttcaacttgtcgataatcctcaccagttcatatttttttactttcatgattcctctctttcccggagttccagaccgtcaagaaacttgacaactccgttactatacttgattttgtactgttccaaattgctttcatccatgtacttatgtccgaagatcttcttcatatcccgaaacacctcccacggtacccgatagtaattttcaaaccctatcgaaaccacaacgaaacacacagctcccattttcctataccgttcaaagcacttttcctgctcctctgttatgacatctctctggatcctgtccttgtccgtatgctttgcgtcaaatagaatcatcgtcgaatcagccagtgcacctttaaagtccggctgtgcccgtttggaaaagcagcatataaactgtcctaactttctgttatgtactccgagcactttcatgggctccggtgtcttttcaatcacggagattcctttttcctcataaaatgccgaagcagctattatcatctgttcaaaataatctccgactgctctggatcggcgaccagccattaccctgttgtaattagatgtacccattttcatccgccacctttatcagtttactgatcgtcacagctccaactcccggaatcttcgcagatttgatgtaatcaataaactctttgactccggttcctttcctggcagatgcttttccgcggttaaatccttcgctgtctgcttttgccacacggtcctccacataatgcaccagctgctcatccgtcatctttctcattttcacagccttttcatggataaggacctcatcctctgttcttctgcaatttctcttactttttcccatatctctactccttgattttatttttttctaatccgtcaatatctggaacgcttacctcatgttcttcgcaccatgatacgaaacatgatttgcacatgtgggcaacgcagcttgtcttcccgcctcttcttgcccttgccgtaatggataccatgtcatttttcggaaattcttttcggcactccacgcattttcccatcagccttttcagaaccttgtcgctcttccgtcttacctgaagatcttgcggaatatcccttctcatgttcttctctttcacaatgtcaaccaggctatccttcataaacaccgggatccccaatgtgccagcctcaagaacgattgattttatccagtcgaactcaggaacaaccattccttttcttttccatgtctccgcaccgatgattatccagtcagcttttccggccagtgccggcttgatccacttcccggaatcttcaagtaatggctctatgcagatgaacttcttttttccttccgggagaaagccggctctatacacatcatccgctttcgtaatggttgttccgtagtacatattcgtttcttccggaagatctaaatccatgtacctctcaggatttaccgtaagaaataaatagttattcttcggatgctgtctgcagatattgaatacgtcatatatccagctgtcaggtacccactccccgaacatatcggccatggcaccaacaagaatattctgtcccattttcagcttgtccagcactccgtatctgtatctatgcagcgtaggctcaaatccaaacggataaagaacctgctgccccgtttcatcgaggaacggttcatccagaacatacactccattttccatccggtacttatcacgctgttttatattcattttcacattaccggaaaaccgcctgctcatctgtcttgcataacagtattcacatttgtaccggcatccggtaatgatattcagcgtatgatcacaatactctatctttgaacggttcatatgtagttgcctcctcctgtgccggcaatttatcaaggagattgcaagcctcctcgactgcctctttcctgaaatcagaataaccgtaatcatcttttactctgattaagatttcaacaatctctccaatcttcatttatcattcctcccaatactcaacggtatattctgtctgtccgtttttcttttcctcctgcccaggaactgtctgccgaccgatccttacagagtaacctgctttcacaagcagcgtggcgatctgcagtctatcttcctcattccactgagcagaacccttacggatgctcctgattatctgtttcgccattatccgcacctccgcatttctttctctttattctcgtttatggtatcctgcattttcttctcaaaggcttttacaaacgcttctacctccggtggcattccgcagttgtgagagcctctgcattggataatatggttgttattccactccattgtgaaatacggtttgtccggttcagtagactttctgacgaaaaatatgtttgtctctcctctggccaccctgtcaacatatcctccgacgcaatgatgtaatgcagctccctccgcttttatctcatcagcagtcttcggtactacaagcaggagaccttttccttttatctggaaagcatctttacagtctttgttctctttaaagatctccgacataacctttttcgtctgttccatacgcctctttgcttctcgttctctccttgccttttctttcgccgcctgtctgtccataagttcctgatgctcttttgcagtacggtcatgcacttttttgaaattctttggcatatagatgaacatattatccaggtcatatttcagatctttgcaccagttaagatactccagccagtccttagccatatttcgttttctttcaatacgtggatcctctcgttccgtgtacctcatatacgaatattgccaacagccaccctgctctcccataggataattctcacattctttcgtgatatatttcacgattttatgaagcgtggttttcctgtttgcctgttgcaatagatctgtattgcacccgaacgtctcataatactcctgaatctgctccgtcttgaactgtaagccgatcttctgtgccacctgcaacagccgaagtacatcgtggtttccatcaacagcctgcaatactctggtatttacctttgtcagtcctaaaatctcatatatggtattccctttaacattgaccttaccggtctgataaccactgtatcgagaattgataaggccttttgcaatcttattgagccccatcttgcagatccattccattttcggaaattccatatacttttcgatcgcatcctcatatctcatggaaactgtcggaagatttgttgaaagcacttccagagccgagtatttcatgggggtatgttcccacgcctgcggcagatttcctggatataatatacattccatgcaggcgatctttccctgatccggacaccagcggcaatttcctctctgcttatacactccccactcataggattcgcatttgggtttccctttcgggaacgtataaatagctctgctgtactccgaaacatacctttcgattctgcctttatttatcaacatgtccacatagctgtcgcttctcattgattggtgtgctttgaagtaccggaagacaaaaccgtctttcgtaggatccacataaacaaaccaccgttcatcttgtgtctgagcaggcattcgtccttttgccttaatggttaccctgctaccgcagaacggacagattcctttctcgttattccgcagacggatgttttttctgtccacaattccgatttctttgcaatgtgtgcattcacataacgccttacctttttccacttccttgtagatcaggtatcgtgcgaagctcattccggtatcccatacccagtcgaaaaattctttcggcgcctcctttatcggattcattaccgcatcgatcttgtcagtctctttcttatgcttttccgccagtcttttgtccaaaacctcttgctgaaatctatgtatttctatccatggactatattcatcatcaggaacggcgtattctttgaagaaaccctttactatttttaactcttcatcagatctcataaatacattcagcctatgtgaacttttattctcctgatgattccacacataatccattagagaaaaattatacattccggcaaatgaagctgttagccatttagtctttgacgtttttaaatcctgcgtgatataatcatcgtgcgacagaaatgtccggaaagctgcttctgtttttcctttcttgagagcctgaatctcaaagaaattcagaagcagtatttttttgtcatcaatcagctctgctgtcgcgatatgtctcattcctccaagccgatctgcgacttccatcatttccggagttgcaattggtcttggaatagcagataattttctcttttccacatccatccctcctacagcagatcgaataacgacatctgaccttctgtttcattcttctttggagcctgctttttgacttctttcaccggtttcgcattaggtgtcttttccggtgccttttctttggcaggcttctgtttggagatctgttgcttacgcttctcagcatcctgcttctgctgttttttccgtttctcctcctcttttttcttcttttcctcaatagccttatcatccaaatggaaatagtcttccgcccattcatagaccacatcatcacggaccgccgcacaatttccatccctctgttttcttgcctgctcatagatataagcaaaacatttcgcccatgttttatgtggctgaagaacatcagatgacaatccatcatcttcctcgcagcgtttcagaagatacttaataaccggatcggcgaaatttttatctttagcatcgttcagttccttttccagtttttctttcgctctctgttttaatggtttcgcattttcctcttctgcctgctttatttcctcatccgtcggcgccggtaagcctttcgctatatctgcaagcgacgctgttcccatcggaactaagtcctcatcttttgttttctttttatctccggatgtggccgcttcaaatgctccccgttcaatcgcatcaatcgcttttcccatagggcttacaggtccatcattctccggatcctcttctacatcggagattgccgatttatattccttttccagacggtcattggttacgtcaaacaacgtatctcctttttcgtcatagaataccgtgatagaatctcttctcaagatctggtatttcttatctcgaatcgtcagttcgcactgtttattctcgctttcatatccagcctcaagatactttctgacaacctcattccacggccacccgtaggtattgtcatctttctgctccaaagcgaaatgttttatatctgctcccattgcatttcctccttcttttcaaaatcaaaaaacatataataatgctctttttctatagtctgtttcgtatctgcagatcctcctaaacttccgagagaatggaacagccgcctccacgcccatacatttgattgaaacatcggtgtgatccacagctcctgcccttccatttcctgtgggaataaaacgtgtccaacaagcggattcgttatggtattgcctatgcagatataaccggcacacccaagaagcgaaagctgtatgtaacacatcattccaacgattctgtctatatcctgaccgacaaataaaacatggttctggaaattatgctttgcattcctcatactgttaacagctgctatcagagttgctccggctccgcaggcaggatcgcagatggatatatatcctttttcctcaatctgcctgtccacatctcccaccgttatctccgacatcattttgcatacacagtatggtgtgaaaaactgccctttccaatggttcccaagctccagttccatgtataactctcccaggaagtcctgctctggattcctctcaagtgcttctaccacaatcgcaaaacactttgcaggtttgtccactcctccgagacgttcgatacaatgtgcatattccttttcccggttgctgaacctcggttcagatctgtctactgcatttgcaatactgcaagccattgtgcttatcagatctgaccacacttgccatccgctcctgctgtagcacatctcattaaatatttttatgaactcttttttcgttccctgtatttcgccggtcattgtcatctcaatcctttctctctcatcagcctgtcaatgaactccggtgaggatggacggaatggttcttcggttttctgctcgatcttcggcttttccggaactttttcttcaatcatgcctatgtattcccgcttcttttccagcaccgccgcaggcaccatggattcatttaccgcacgttccacaatcgcatcatatatcttgaagaaatgtgctctgtttgccacagggttatctccgtagcacaattcacggaaccctattctctcaacagcctgcttcgttggaccggaaaggctctccatagcctcatcagatctgtaatacccatatttctgaatcgccttctggacatcttcccaggcctccccggcgtcttttagctgtggtgctgtgtactcagcacattttgctcttatctcggaaatctgcggcgggtaagtgtgtgttgctatcaattcctgaagtgctgtctcacacagactgtaatcaagatctccgagcatcgtgtaccacagctttatgctgtatttgtccggcatgatgttaaaagacggatatgcacttttgataatcgctctgatgatatcgaattgttctgctgtcaatcattccaccccgcagtcgattccatatactgttctgttccaatgttccggtttccaccggggtgaggtctgtatgcaggtgccttatcctgtgccctgctcagccacccggtaataaatcttttgattcctcttgcagtctttctgtttcttggattgctatcaagccatccacacatttttctaaattcctgttccacatcaatcgccggatataactgtcggagagaattcaaatagtcaaaagtgacatcgaaagaaccggatccggtaacaagtggtaaggatatgaacaccttctgctcggaggtttctacctccgggcataatgtatttatatctttctctttatctatctctatctctttctctatctctttctctacgctcccgttttgttccaatgtgttgcatggtgttgcattggtgttgcattgcaacgcttttctctctctacactgtcttgaacgctgtgtactcgccgcctcggaacccaccattttatcgcattccgttaggcggtactccgtttcatcaaccaactctattaacccctgtgcaagcaggaatctgacggttacattaacgttttctgcttcttcatccagttccagggcgagttcttcgtagaagtcatcttccactccctcaaagtaaagccggccgtcctgtttcatggcgataagcagcattttcagataaatgattgtataagtatctccaccggcgatcttgcggagtttttttattggcttctgccggaagaaatcatccggcagctttaaccaatagtatcgttttcccatataggtgcctcctagtaaattactttagagccctcttccgttttgataacggtcacactctgattgaatcgtgctttcatggcatcatcatgtgtgattgccattacttttacatccggataccgctggcggatcgcctcaagggaatccacataagcctgtgttccgtcatcatcaaggaatggaggctcatcaatgaacaacattccaagctggataccggcggctgtagccttaatttcagacaatgcaaggataacagccaatgacgcttttactttctcaccgccgctcttggatgcgtatggaagtgttgtcttaccatactcctcgatcaggacatccagtgtagccttgtcaccgtcttttccttttaccgttcgctccatcacgaaatcgacacccattgttcctccggtcatctggccaaggatattgtttgccgtgtccgtgatatgcggaatgatattccggataatctgatgaggaacgccgtcctgtgagaatgcctgctttaaaacgtcatatctcgttgtaataagggcacatgcttcaatatctttcttcagttcggaaatctcctctttcatggacttaacatcttccgccttctggataagtgttcctttctgcacctgcaaatcctgaagctttttcttttcagtttccattctttcctcaagatcagaaactttggattccatacctgaatcaaaactttccataagttcagatgcagaaatcatatcggctaccataacgatcagctcttcatctttcttttcaagctgcttttcctgcattgccatattttccctggcatttttcactctttcctcatataccggaagggacttctcctgttccgcatatactttcagtccgtcagccttttctttgacctgttcgtataaattaactctttccgaaaggttattaactctttccgttatctcttgagcctgtaatttgacctcagaggcgttttcagaacatgaggcgatagttttatcgtttgactctttttcagcctccaggcgggcacgtttgagcctgctttcttcaatcctctgtttctttgcctgatatacttccagttctgcaatccgttctctgatggacgtctccttttcttttgaatatccgatgttctgcagctcctcctgctttttctgttcaaattctgaaaaagcagtttccgcctctttcattgcctccttgatcgtcgaaatgcacttttctgtattttcgattttagaggcatcctctttcgcctttttaagaaatctgcagtttgcattttcgatatccgcacatccggaatcttccatgtaggctttctgctgtttctgcgttgaaagatctgattccgccagacggagctgtgtttcataagtagcattcgctttctgaaattcatcccgctttgcagatacttcctgcaacacagcgtcatgggcattctttttatccattaccgcataaagctcttctcttttttcttccaattcagcaatcttttcagcgattccatcatcagaatccgtatccagcccagaaagctcctgatcaatccttgcgttttcaaactctgcattcttaataatgttctggtatctctggagattggcttcgcagtctactaaagctttcttctcgctctcataacggataagctcctctgataagatcttcatttcatcctctgcagctgaatactcttttgacttctcccggatgacatccgctttttccaggattgtttcgcaggattctataatggagttcagcttatttatggattcctcaatagacgctttctcattttttacctgttcttttctactgcgaagatcttcgcaatttttctttgcagcttcatacttaaccaaaagtgcctgagcatctttcaaatctgtggagatttctccgatcaacttttccgaggattcaatctctttttccagctcttccagttcctcctgcggattgcctttgctagcgataatgtcatctttgatttttacagcatctttcttctgcatcagagtacgtttcgcatcaccgagacgttttctcgcatcctgctccataattccgtaaattccaagtcccaacagatttccaaggatagagattcgttcatcttttctcgcctgcaaaaacagtccgtactgatcctgcataataagagcacagctgcggaatgtcatggaatccattccaagaacccttaaaatctcactctgtgtatcattgattctttcttttgaaaggttcagccagtcggtaccgtcctcattcagctgtgaaaggttcaatgttggctttccggattttgttctggttctcactacccggaacctgctttcaccaatgtcaaatacaaactcaatggaaccgcttctggcatcttcggtacctctgatccacgacttgttgtctccttctctggtttcttcaaataagcaatccgaaatcgcatccataaacaggctgctctttcctgctccattcacaccgttaatcgtgcagaaagaaatatcatcgaaatcaaagaattcttccttataggttcggtagtttttgaccttaatgcttaccggtttgaatacaccgtggatctcaacagtgttactgctcttcatcgcatcagcgataatcggctctgcaagttccacaattttttctgaatcggtaaagcacttctcatccaaccatttcttgaggtttaaaagaggatcactttcttcggaaaggagctgccgattcgtgatgttcatcatgctctcagcttcaatatccgccacatagaacgctccgatttcatacaaatctttttgtaacaccggaatgtttaatgccttcttctgttccgtgtcgcagctgtactgcagtctcactatggcgtccatgcaggaagatgcgtaatctttctcgagaagatacatctttccagatctgagatattcagcaacatcttctttatcccatttaatcgtctggaacttccggtatggagtttcatataaatgtccttttttcaggcttttcttttcaaattcatggatccagaatccacgtttctgtccttcatcgttgaaattcatagcgtttatggcaccggaataaaatacattttccagaccttcgagcatctgcgggcggtggatgtggccaagaagaaccgcatcgaattgtgctgtctgcagagcctctctcggaattaccggctcaaaatttgaaaagaacgatgtctgtccggattccatattgcaacccggaactgtataatgtgccatcaggatcgcaggaaccatatctgccacaatatttgtctgtgagcattgtgctctcaatcccataaccatttcgctgatatgattggtccatgtaagattttcttcctctgcagaaagcccagggaatttagctctgaactcctgcttatcaaacccaggaatgcatacaatgtcagcgatcggcgtactgataacctgcggcgttgtaacaacagcaacctttttattgtgttccagcatctttgtaagtacacggaactgtccggcgccgtcatggttcggtgttcctctcatgacaaccacgaatttgctaactttcgacagctcatcaataatccttgttgcagtcaccatttcgtcagaatatcttaccggtccgatctgctcctgatggaacacatcaccgctgatacaaaccagatccggcttttcttccttcgccttttcaaccatatattccaagcattttactgtatccagggaacggagattcactccgtcctcaacaggacctttaaactggccaatgtgccagtcagctgtatgcaatactttcattacatttccctcgctttctttgttaattcctctaatttcggataaagaatattgaactgctgttctgacattccgcagaagtcgattccatcacctgtccatacttctccgacaatcaggatatttcccataatcggagatccatgtttgtctgtttcatacaggaaacttcccacaccattcatatcaagatcatggtaaagaaattcttcatcaaccagcatgctcacgcagcttccctttgcttttccaaccttgtttgatcctccaagctctttgtataacctgtttggcattacatgctcacacagtctacatttcggaccgatgagatctgcgagcgcctcattctgctcggaataattaccttcagggaattcatgtactgaaatctcattatctgttgtaatttttatgagtttcattacttgttaccccctctctggcatttaatgcaaagcggccggccaaacttattcaaagagtattcgtaaactctttcgttgatctctgctccgcaatcattacaaaaaagtccgttttcctcttgtgcaagatcactgcccgccgactcatcaggggcaactccatcgtgtaccggttcctgatattctccagaaaaatcatcttccggaatatcgctctgaaatgccggattgtcggcatattcagaaacatcaaatgtattttctgtttcaaaatccacacgtcttacaggaatttctggtgtgccgaacatattattcacggactgcattccctgcgtaagcattgcctgacggacattcggatcggaataatcaggcgaaaatacaaccgtcggaatggcgaagtttttcttgagttcttcatgagtatatgttcctttcagtccgagcaaagcacgaataacacggagttttgctccggtcatagccttttctgcccaggtctttctaagctgcgtcatatttacaagaacagatctctcgatatatttttctctgtcacactcgtcaatcacatatccattgacttcttttccgaatttattcttcaatttcttaaactcgcctttgaagagttcagctgcagctttcgcctgcttttcatcggtaatgcctttcactgctttatcaccgaattcaattcggaacttagcctcttcatcttccaggcagatcactttctgatccgtttctgttcttgctgtaccatccgcctttttcatggccccctgtgcctgtgcccggtatgtgtacttatcaattctttctccatatgtttcctttggattgaactgaatcccagcagccatagcgagtttattaagcatcggttttgtaagcgaaaatgcacttacccagattgtatttccactccggtccttctttccgctgtccacagaaccgactttaaaaatgtctccgctattttctccgagatccaccggaacttcttcgacatgaaatttgtagaaagggtttaactgaacatccgtagatgtcggcaacaataagttgcactgagaataatgatccattacctccggtaatgatgataaaaattctttgctcattgattttcctccgtattcattgacttttttcccacatccatgctaaaatacggatgtggggtgtataggtttttcacccttggattcactcgctaaagcgattgtgaaatccgaaaaaagtttctgagttaaagcttcaatcactaattcagccagataccatggtgtccgtctaacaccgttggcatcgccataacgctgtattatggattggagctttttcgttgctgtacctacagcaagctgatagtcttcttcattgatttctcttccgatcatctcctctattgtcttcttgtccataaccaatctcctaaccattgcaaaaacaaaaacattccgtatgccacaagtccggccgcgaatacttctccgcctatagcatcatatcctctcacttcacgaagtttctctgctattgctatgtaaaaaaggattccggatgcaaacgatattgccagttgtgcgagcatgatcgccgcccattttagtttttctttcactactctgagaaatcttttcattgctctttttcgtgaatatttcttcagaacctgcggattatataatgcaacccgttccggccggaggataacctgctctgtattatttatcaggtcatacagtacaaatggtttcattttctttctcctttacacaattattctcatctgtccgttgttctcggcgcagataaggtgagacagtttttcaaccgagcgagcaatccgctcctctctcatcttctcttcatctttgcagtcacatttttctcccggatccagataacatccacattccggacaaatataaccatacattctcttcttccctcctttactcaatcatgcagttttcattaaagtatttcttcgggattctcccgtttggataagcctttgtaagtttaccgctatcaatgcactcctgacgcatttcccggatcatgttatacgctttggactggctgacatccaggagcttcacaatgtcatcaactttatagtaagaacggttggaactatccagttccttgacaataccagcagccatatctcatcctcctatctaatatttttttctgcccatatcttcagctcgttagtaatctgagtgacctcatccagtgtcttgataatggtttctaagtctcccttttcctcttcagtgatcatgccgtcttccgtgatgtccaaaagcagatcttttgccttcgatatttttctgaacgaagaaagagcttttacactgattctgtcaagatcttccgattcgacttccggaaaatcctttccaagcggacacatatacttacaaaaatgagccttcagttccggagcattatatatatctgacatcataagaacttcatcaggaaatggatttttactgccaagctctattctcgcaagcctgcttcggtcaattccaagctcctctgacgctccctctctgctattcagacggtcattgaactttgcggcgttgtaacgtgcctgtgtgaagatattttcctttgcttttgttgcatactttgccatttaagtgacctccgtaataagctaaactataatcaaataactgtatcggtgtaaggaaccgtaacgtgtctatcctcaccgatcaccttcgcgatctcaggtgcgtagactcggccattgacaacaccagaaacataatttctgctaaatccaacacgctctgcaagttcagtcacgttaatatcatcatcaatcatggatttttttacttctttgcaccatgtcggaagaattcgtttcatttttccacctctttccgtttgttaccatttgttgtttacatttgtttaaaactgccttagaataacggtatacgttaatcaaaatagaaaggagtatctgctatgaataatcagacttcgtggtcggagcaattacaacgcattggaatgtcagagttttcgtcggctcatcaggacatccttatgcagttacgagaaagccggattccgataggatctgcttctctttcgcaagcatctgccgaagcccttatacgggctgtgtcagtaatgattgaagaaaataacaaagccgttcttacggaattagaacagtaactattcattttgcattacttcttttgagcgattttttcgctctgtttttgaaaagtgttttaaacatttggtgattacagttttataataatccccatttgtgagtttgtcaatacttttattcacattttgggattttgaaaggagcactatgattattcaaagagtattatctctacttgatgagaaatcgcttaaagccgcggatttatgtagggctttagatataagcactagtacaatgacaaactggaaaaacagggggaccgatccaccggcaaagatgattgtcccaatttgtgaatttctcggcgtttcatgcgaatttctattaacaggaaaagaaagcatatttcctgcaatatcaaaagaagattctgaatggctggttctaattcatcagctaccagatgatgctcaattagaattcaaaggagagctgaagggctatataaaatgtctcaaacgagatgttggtgaaccagcgggattgagagaggcaaaataatacccttcgagtggtaccgaaggggaaggagagattaagtatgagcatgataaactgtccagaatgcggaaaagtaatatcggacacagctacaacttgcccgaattgtgggtatgtattgaaaaagaaaaagcctgcatggattatagtgctggcaatcataatggggattgttgcgattatcgttcttgcttcaggattcaaagatcttttcatatcaaaagaaattggttctgataaaaagcaacaagtttccgaggaaaagaatgccgaatcacagaaaacagcgtttcagtttgaggtaagcacggatgaagatcttgtgggattcccagacgctcaggggtttaccgaggtatccgacggagaatttaagacagcaatggtaagtataggagtaaaagatatatctgatgtagaaatcgggaattacaaagaaaaatctggcgtttactttctcgacgcaaagtgtaaaacagatacgggtatcacgttaattatcgattatatgtacatctcgttctcttctgatccagaatggaccatttgctatattgcggactacgattctggaaaatattattatgtaagtgaagaatctgagaacgaagtggatatatatgattacaaaacaggtgaattaaaatcaaaagccaatcctagttcaaacagtaattaaggtgtaataatgagtgatattggagaaagaatcaaggaactgcgttcggaggcaggcattacccagttgcagctggggaaatatgcaggatgcaccggccaggttatatctaacatagaaagaggatacacacgcccatcggcagaggttcttaacaaaatagcagattccctgcatgttccttcagactatatattgggaatctctaaatcaaaatggattgcgtcaaatccatattcgctgaaccgatgtttacaggaaagaatctcttctctattaaaaaaagaacaaatgacaatagaatcattcgccgcagccgcagaacttgaccaagacgaagtgtccgaaattgtattcggaggagttcagccaaatacagacacactggccaggattgccggcactcttcatacaacgatagattatcttatcgggataaacgaatacgaagtctcgatagaaactgaggaagaaaaagacattatccaatatttcagaaaaatgtccaaaagcggcaaacgaatattcatgggaatgttggaggaggtcaaagacaaataacacgagacaggagactttgcaatgccagcatacaaatatcagttgaagaccgggaaaacgaagtggtatgcgaacttctattatgaggactggacgggcaccaaacagcataaatgcaaacgtggttttgatacgaagaaagaagccaatgaatatgaaagactgttcttggataagttttcaaagagccctactatcctgttctcttcccttgttgacaactatctggatgatatgaagaccaggctaaaaccaacaaccataaaaaacaaagagtatcttataagaacgaagctggttccatacttcggaaaattgcagatctgcaatatagacgccgaggttataagaaagtggcagaatgtgctgattgaatatagggataagaaaggaaatccatatgcagagacatatctctataccataaatgcccaaatgtcagcaatcatgaattatgctgtaaaattctacagactgcagatcaacccttgctttatcgccggatccatcggtaaaaacaaggcaagtgaaatgaagatatggacgcacgatcagttcaaacaggccatagagcacgagcagaaaatagcatacacgattgcttttaaaatcctattttacggaggcctccgggaaggggagttgcttgcccttactcctgatgacataccgagagatgaagccctgattgacatcaataagaattacgccgtagtggacagggtagaatactttctcactccaaagacagaacgaagcgtccggatcgtaaccataccggatatcctgcacgcagagattctcgaatacatcgacagcatagaggttgatcacgatgagcgaatcttctattttgggaaaagcggtctgtccgatgaatttaaacggatgaagaaaaaggcagacgccgaagatatacgaatccatgacctgagacacagccatgcagccatgctgataaatatgggtgttggaatcgaagagatctccagaagactgggacacgattccattaagacaacatgggatacctactcccacttatatccaggtacagacaaagtgcttgccggaaagatcgaagatcttattaagaaagaagcagaagaaaaagatgttccgaaatatgatgtttccgaatcagatatacctatggttcctgagtctcctctcggaaagcagagccagtctattctgtttactgcagcgaagaagagcaatgttcatattcagaagaataaccgaaacatcttccagaagtacggtatcgatattgataatgaggttttattcggatataagatgatagactatctggacttcatagcattcggaaattcaatcattaacatcatcacggatttccatccggaagaaaagctaaaggatttcattctgtcgatgttcacggaatccatttcggcatgcgaaatggcagacggaaatatcctgaatctggacacatatatttcccagacagccataccaagataccataaaatatatggaatatatgcataattttattttttaacatcaccgtaacatcacggatataaaaaatcccctgagagcccagtgtttatgcgggttcccaggggatacctattattcgaactcaatcgttcccggcggtttactcgtcagatcatagaatactctgttaaccccacgaacttcattgataattctgctcattactttatcaagtacttcatacggaatcttcgctgcctcagcagtcataaaatctaccgtattcactgcacgaagtgcaactgcataatcgtaagttctctcgtcacccataacaccaacgcttctcatgttggtcagggctgcaaaatattgtccgatgctgcggtcaagtcccgcgtttgcaatctcttctctgtaaattgcatctgcatcctgtacgatccgtactttttcagccgttacttctccgatgatacggattccaagtcccggtcccgggaatggctgacggaatacaagcttctccggaagtccaagttcaagacctgccttgcggacttcatctttgaagagatcacgaagtggttcaatgatttctttgaaatcaacatactccggaagtcctcctacgttgtgatgagacttgatcactgctgattctccgccaagtccgctttctacaacgtctgggtaaatcgttccctgtgcaaggaattccactgcaccaatcttctttgcttcttcttcaaaaatacggataaattcttctccgataattttacgctttgcttccggttctgtaactccggcaagcttgttgtagtatctttcctgtgcattgacacggataaagttcaggtcaaactgaccattcggtccaaatactgcctcaacttcatcgccttcattcttacgaagaagaccgtgatctacaaatacgcaggtaagctgtttgccaattgctctggaaagcagtcctgctgccacagaggaatcaactccgcctgaaagcgcaagaagtactcttccgtccccaactttttcacggatttcctggatggtattttcaacaaatgcatccatcttccattcgccgacacatccacagacattctttacaaagttgttgatcatcttggttccttccggtgtatgaagcacttcaggatggaactggattgcataaagcttttctgctgcattttctgctgctgctaccggacagtctgctgtgtgtgcagtaatctcaaatcccggtgccacctgcgaaatataatcaaaatggctcatccagcaggttgttgttgcagatacattttcaaatactttggaatctttcttgtcgatgatgacttctgtcttaccatattctctgacgtcagctttttcaacttttccgccaagtacgtgagacataagctgtgcaccataacaaagaccaagtaccggaatgccaagcttaaagagttcttcagaataagtcggtgaatccggttcataacagctattcggtcctcctgtcaggataattcccttcgggttcattgctttaatcttttcgatatcaatcttataagaataaatttcgcaatatacattacattccctgacacgtcttgcgacaagctggttatactgtccaccaaagtcaagtacaatcactaattcgttcttcaaggttttcctcctgtaaaatacgatcctttcagaccgctttttctatttattgcttttatattttattatagtagagctctggatgttttacaagcattttctatcgcccaaaccaaagtttgaactctggtctgcaattaaaactcatattcaagcatcatctttctaacacaaatgacaactttcttctgtatttacacaattgccccatgtttccactttccattaaagtaccggataataaaacagattgcacgtactacccagtcgatcaccattgcaacccacacgccaaatactcccagtcccatatattttcctaccagataactgaatccgatccggaaaatccacatcgacacaatcgatgtatacatacaggcttttgcatctcctgccgcacgatacgctgctggaagagcaaatgaaagtggccagataatcattgcactgattccatggaaatgaataatatttgttgctgccgctgctgtctgatctgacaaattgtatgctttcaaaatcaatggaagtgcaaggaaaataagtgctaccgttcccaccattgccacataaatgatcgcaagcagttttttcagatagtaacgtacctgttcatagtcatttgcgccgacgcactgggaaataactgtcgtaattgccagcgagatcgccattccaggaagaatctggaacagcgcaatcgcattggaaactgcatttgccgcaattgcataagtaccgaaggttgaaaccagactcagcactaaaattttgcccagctgaaacatactgttttccagaccattgggaaccccaattgcaagtattttccgtatcattcttccatcaaaccggattttcagtgtccgctcaatatgcaagatacgtgtctgattgcagagcaacgctgttatcactatcgcggcaaccattctggaaatcagtgtcggtattgcaacacccgccgttccgatccgtaatccgaacacaagaattgcatttccggttacattgatcgcattcatcaaaagcgatacccgcatggatacctgcgaattccccatcgcacggaaaattgctgccccaccattatataacgcgataaatggaatcgaagctgttacaattagcagataaatatctgcatgtccttttacttccgctgtaatgtgaccaaatacctgattcagaattatatcttttccaaagtaaaccaatatcatgatcgcaaccgcactaaggctcacaaaccataccagctgtgtagccgctttacatgctgatttttcatctttcctgccaatatactgtccggcaacaactgctccaccagtcgccagtgctgcaaaaatattgatgatcagaatcataatattgtcaaccagcgacacgcccgacacagctgcttctccaacatttgcaaccataatagaatctgccatcccaacaaaaactgccaataactgctcgattaccaaaggtccgatcagatttgccagttcccgattggaaaacagataatgacttcgatcctgtttttgtttcgttttccccattcttctcttttcctgtcccttctcttttgtatatccccgttttctctattatatactgtaaaaatgtaatacaccatctttttgcaaagaaaaggattttttatgcgtgctgatgcaggtacttttctctggtagcaagtccgccccggatgtgccgttccgatttgttcagatccagaacctttcgcgcctcacctgcaagagatgggttgatctggagaagacgttctgttacatctttatgtatcgtactcttacttactccaaacgccaccgccgtctgcctcaccgtcgccttattttcaataatataataagcaatctcaaccgctctctcctcaatataatctttcataaaaacccctgcatagtttgttttttttacaatctatgcaaaggcgaagggatgtatgtctgattaaacttccttcaaaaatatctcattcaatttctcccaacttacctttttttcttcccctaattttcccactttctctctcaatcctgctatttcactctccagaatccactgacctgccagtaatattttaccatgctctttttcttctatttcatgaagtttttgtactattattttttccatcagcttcccctgcttttcctttctagcatatagctgcacgcggcgtgcagtcaaaggcttttattttggaattctggttatcttctccatcactccttgaaagagcatgtttatttcgcgaattctccagattgactttcccctcctcataagttatccttatcatagtacgccatgctgacatatttgcagcactggtgaattttattatttttacaggtaaggatttgagaaaatgagtaaaacaaaaacaatcgacctgacttccgggccgattctaaagacgctggcagagctggcacttccgatcatggcttcctcgctgctggggacagcctacaatattacggacatggcatggataggcatgctgggttccaaagccgttgccggggtgggcgttgggggaatgtacgtctggctctcacaagggctcgtggcacttccgcgaatgggcggacaggtcaatgtcgcacaggcttgcggacgcggagactatgaacaggcaaggggatatgccgcttccgctctgcgacttacatttttactgggaattttatttgctgcagtatgtatcgtgtttattcatccgctgctcggcttttttaacctcggagatgcagaaacttataccgctgcgaaattatatacactgatcacctgcggactgattctgttttcatttttaaatctgactctgaccggactttctactgcgcagggagattccaagacaccgcttatggcaaatcttcttggtctggttggtaatatgatcctggatccgattctgatcctcggatttggaccatttccaaggcttgaggttgttggcgctgcagttgctaccgtgacctcgcagatactggttctgatcgtcatgctgattcggattatgcactctgatctggaaccaaatattctgcaaaacatgcatgtactgtcgcgtttccctgcaaaatactacatcagtatttttaaaattggatttccgacagcagtacagagcagtatttactgcatgatttccatgattctcacacgaatggtttctgcattcggggcaggtgccattgccacacagcgagtcggcggacagattgaatctgtttcatggaacactgctgacggctttgctgctgcgttaaatgctttcgttggtcagaactacggtgcaaagaaaccagatcgtattcggaaaggatataatatttcatttaaaatcctcgctgtctggggactcattgtaaccggtgctttcgtattcctgccaggaccgattgcttcccttttcttccacgaaaaagatgttctggcgattgcgatcaactatctgatcatcatcggattcagcgaaacctttatgaccattgagcttatgaccatcggcgcactttccggtcttggtatgacaaagctttgcagtatcatcagcattgtcctcaccagtgccagaatcccacttgccatgatcctcactcaaaccagcctcggtctgaatggtgtatggtgggcacttacaattacctctatcaccaaaggaattgttttctacttcaccttccaccacaccagcagacacctacctgacgctaatgacaattaatttaactacccaccttttttattttttcctgttttgtttatttcttcttcatatttttttgattttttttagagtttgaacatatttctgtcacaaattatctgtatactaataatcagatagttgataaagcaactatctcccccctcataaagtagaagcagtcagaattctgattgctgcactttactctcattccttttagataacaataaaaacaccaagaacctctccattatggagaggttcttgcgttgtggatttttttaatattctataaacctatcatttttatatttttaatcagattttataatttcttaacacttttgacacattttcatcgtatagtaataaatggatagttgggaaacaactatctcccccctcataaagtgagcgcaatcgggcatgcccgattgccgcactttgatttttacagaatattattctgggacgaaggttatcctccgtcccatattttatttgtaaatgcagtaccgtgtgcccggatatctacctgcacaaaacgttagtcacggccattcatcatcaaatgaactcaaaccttttacgtccttgcacgaatgtctctctggtacatcatactttttatcctcaattaccggaaaggatttattatgaaacgccctactttacataaacttattttttcaattcttttatttgccataagtttccttgctcttttcaccagccacaaaagctctgcattcgcggactggtattcttccaccatttacccgcttttcgtttcgtccatcggacgcttttttggaatcttccaattttctgtttctgaaattggattgtatatttttgtcattcttctgtttctttccttggtccggatgctgatcagctccatttacaaaatgtatgccaaaaaaaagaaccctgcctggctcggctacggttcctcactcctgcttctctgcggatgtctgtttaccatttatacttttttctgcggaatcaactacggacatacttcatttgcagaaaaatatcacctggaatccggtcagtatactcaggctgaactgacctctttatgcaacgaactgattgatcagttaaatgcactttctgactctttagaccgggattctgacggtcttgctgatatgggtaaggatctgcaggatcgtgcacgggctgctatgttctccctcggtgctgcctaccctgaactttccggatactatccacagccaaaaggtcttttatttccggcttttctctcggtacagaatctttccgggatctattcaccatttaccattgaggcaaactataactccgcaatggtttcctacaatcttccatttaccatctgtcacgagctttcgcatctgcgtggatttatgcaggaggaagaagcaaattttatcggttttctcgcctgtgtaaatgccgacgataccgccttcaactacagcggctatcttcttggctggatctacgcaaccaacgaactttacgaagccgactacgacacctttgaggaaatctacaacaggctttctgacaatgtaaaggcagatctttcggctaacagcagcttctggaagcgatatgacagcaaggtcgccgaagtatctggtcagatcaatgaccactatctgaaagcaaatggccaaagtaacgggataaaaagttatgaccggatggttgatctgatgatcacctggttccggtcaaaataattctttcttataaagtttactctttctctccagcccgaaacagcatctctttcaatacgtttgccaccatgctgtgagggctgctcttatcttccacaaaacagatttctcttaccggtggttcttccaatagtggaacctgaatgacaatgccctgctcgatcacttcctgtgcaagcggttccggaataaacccgattcccagattctgtcttaccatcggcaaaatctgatcgatggttgctgcttcggtatctgccgtcattgcaattccatgctccagaaaaaaactggtataaaaatcataagttgacgtgtttttcccaaggcagataaatggatactccaccagctttttcaaacttaccggttctttaaacatatctttgtacgccgcattcgcaaccagaatttctttaaatgaaagaagcggaattgcctttaaaggctttttcacctctgccggtgtagatgctaccgcaaaatctgaaagtccgttccgaaccgtctgtatcgcctgtggtgctgtataactcgaaatgcgaagtctgattttaggatactttcttctaaactctcccagcaccggaagcagaagcaaatgcaatgcaatctcacttaccccgatcgttacggttccctgttccagcttcttttcattttcaagctctagctctgctgcatgcagatgatcgtacgcaattgcaacatgtgaataaagccgttctccctccggtgtaagctctgctccccggttagaccggataaataatctgcatccaagctgactttccagattgtggattgccctcgttacattcggctgattactcatcaggattgtcgccgcctgtgagaaacttttatactttgccgcataataaaaaatacggtaataatcatatgtaacttccatcttcctgctccttgttccgtatatctcaggcatatccagtgccgcctttaactgaacggaatcgtaaccggtgtacagtcaaatttttcaaaataactgtcggccagatgttcctcttcgccttcgatcagaagatgcatcttctctcccattcttatcgtcatcagtcccacgatcgatttggcatcgatctcgaaacgtcctgtcacatcctttaccgtaatatctgcattcatcttctggcaaacattacaaaaagtcatcaattgtcctgtagtcataaaacgtatattcctctgtaccataataggtcaaccctccgcaagtctttttttcctgatgtctagtttacacaatatcgtacaatttgagaaatatctctttgaaatgtctgatatgtcatttgaacatatcagttgtttctttattttacatactacatagcagtttgtcaacactatcggtcatttaaatttttatattctcgatactctgccagtggcatatatgccggacgaataatcttatccacattgatcagctcttccagacgatgtgcactccatccaacgattcgcgctgcggcaaagatcggcgtataaagctgctccggaattccaagcatatggtaaaccagtccgctgtaaaaatcgacatttgcatttacccctttatacatctttcttttttcggcaatgatttccggtgccatatgttccactttctcataaagtgcgtattctttatcgtatcctttttcatgtgcaagctgagccacaaatttcttgaaaatctcagcacgtggatcagatactgaataaatcgcatgacccattccatagatcagaccttttctatcaaacctctcccttgcaagcagaccttccagatatgctcttacctcatcgtcatcttcccagtctttgacctcttctttcatatcagcaaacatctgcgtcactttgatgttcgcaccgccgtgcttcggaccttttaacgatgccattgcagcagaaattgtagaataggtgtctgttccggacgaagtgacaacgtgagtagtaaatgtagagttatttccaccaccatgatccatatgcagcacaagtgccatatccagaatccttgcttccagctccgtatactgtcggtcttcacgaagcatcatcagaatattttccgcggtggacttctgcggatccggtgcatagatgtacatatcctgaccctgacgataattgtatgcatgatatccgtagaccatcagcatcggaaattcactgatcaggttcagacactgtctgagaacattcgggattgaagtatcatcagctttttcatcgtaagaatacagattcagaatcgcccttgaaatattgttcatcatatcacggctcggtgccttcataataacatcgcgcacaaaattcggcggaagtgtccttctctccgtcagtgtctcatgaaacccatccagctgtacaaccgtcggaagttcaccaaaaagaagcagatatgcaatttcttcatatccaaaatgatccgcatccaggaatccacgaaccagatccttgatgttatagcctcgataatacaaattaccggcacacggaacttcttcgccatttacaatctttttggcacatacatcggaaatgttggtaagtcccgcaaggactccttttccgtttacatcacggagacctctttttacatcatgctttacaaaaagttctttgtcgatcccggtattcgcttcacataatccggcaagttccttgattttcggcgaaatatcaaacagaatgctatccagatctttcgcactgttcactgaatttgtcatacacctactcctttctgttaaagactctgcaaatactgcagaaagtatgaatgaaggacggaaacacgcacttttagcatcgtcccccgtcccttcttcttatttgtaaactacttactacttgttggaaaatatggtctcaatgaatctgccacactgctgatcggcattgtctgaagccatacatgtcccggtcctgtaataaccgtattaaataatccttctccgccaaagacaatattcttaagtcccggcacagtctggatatccatctggcatgttacactcatcgctgccagataaccggaatcaatcacgatctgctgaccaggttgtaattcgtattctaccacatgtccatcgaattctgcaaatacaattccatttccggataccttctgcaagataaatccttctcctccaaatagtcctgaagccactttcttgtgaaaatgaacagatatatttactccaggttcgccagcaaggaatgcttttttctgaaaaatatattcttgccccggtccgatttcaaatgccttgatcgaacccggaaagctggatgcaaatgcgatcagtccatttcctccctgtgcggtatagatattctggaacatcgcttctccagagaacattcttccaaatgcttttccaaatcctccatttgtcgaagtctccatcttcatattcggagacatccatgccatggatccccgctctgtgatcatccgctcgccagcttccagatggcagatcactaccggaagggtatcacccttgatttcatacttcatgctccatttcctcctttataatattagtcagtctggcaaattcttccagatccagtgcttctccccggacactgcttccttttccgagtttctctatcgcagcagtaatgacttccttcgaaagattcagctctcctgaattcttaaggccatttgccaaagtcttcctcctctgattaaaggatgcccgtataaggcggaacatcagcttttcatccataacctctaccggaggcttctgatgtcttgtcaggcggattactgctgagccgactgccggacgcggcatgaaacagttcgggggtacatttgcaacaatatacggctctgcataatactgtacagcaagtgaaagtgcaccataatcctttgttcccggtcctacctgcatacggtcagccacttctttctgtaccataaccgtaatactctcaagcggcacatggctttcaaataagcccatgattatcggtgtcgttatataatatggaagattcgcaaccaccttgatcggccgtcctccgttcttctcctttgcaagtgctgcaatatccaccttcaggatatcttcattgatgatcgatacgttgtcatattctttcagcgtgtcttcaagaattggaatcagtgcacggtctatctcaactgcagttacttctcttgccgcacaggcaaggtactgtgtcatcgtcccgattccagggccgatctccaacacgtaatcatcctttgtgatctcggctgcacgaatgatcttatccagcacatgctcatcgatcagaaagttctgtccaaattttttctgaaaattaaaattatatttttgcagaatctcaatggtattctgcggatttccaagtgtaggtgttttcatctgttattctcctgattattcattgcctgcgtcttagatgccgtacagatctctcgcatttttctctgtcacagcgatcacttcttccggactcatctcttttaactctgcaattttctcagctacatactggatataagaagactgattccgtttgccacggtacggctccggtgccatatacgggcagtctgtctccagcacgatcttctcgatcgggatcgcagctgcgacatcttttaatttctttgcattcttaaatgtgacgactccaccgattccaatatagaatcccatcttcacatattcttcagccatttcacgtgaataggaatagcagtgaataactccgccaagcccctgtgcataatttttcatgatatacatggtatctgcggcagcttccctgctgtggataattactggtttctttacttctcccgcgagctccagctggcggataaaccacttctgctgtacctcatgcggttcattatcccaataataatccagaccgatctctccgactgcaaccacttttttgttacagcagagttctttcatgtgctggatcttatcttcgttaagttctccaacctcatccggatgcacaccgattgcagcataaacatgtggatactttccggcaagtgccaaaaccttctcacaggattcataagtcgcacttacatccacgattgttccaactccaagatccggcatagattttaaaagctcatcccggtccccgtcaaactgttcatcatcataatgtgcatgtgtatcaaatatcatttccttcgtctcgctttctttttactgactgctctcagatgttctaagtataccacacattcttagccgctgaatagtcactttttttacttgcttatccggtttcttctatgtatactatagatagtgcaaatagatcacatctgcaaatgtatggggaatatatttctgaagattctgatcagatattataggaggattttaaaatgaaagtatttgacactgtaaacaatgtcgagctggaagccgacacaaagaaacttgtagacattatggtagacggacgccaggttgatgtatacctgaaagaaaagaagtctgatgaagacggatacatgagctgggatgtagagcactggtcagcaatcgacaaaaagcgtttcatccgctgctactctctggaaggtcgtgtcctcagcgagtctactggtcacaacatctatgacctttacaatgaattcaaaccggaagatgctttaaaggtagagctcagctaatctctgctgtattctacataagacggtaatgaaattccggacgggcagaactttctgtccgtcttttattgtacaaaaatatactctgattctgcacaatgtcttttctgagatactttttcatttcctcttgtcaaatccggcataccgcgctataattctatttgtacaagtttatatgtaccagggagctggagattgccggctgagaggggatttatttatcccgacctgtaacctgatttggataatgccaacggagggaatgtataccatgtatttgatagagatgcctccgcatcttttattttttacatgacatatcaggaacacgaagatgatgtgttcagtgattacggacagcaggaactccactcaggtgtggggttccttttttgtgtatacaatgagacaggaagttcattttgaaaggagaactctactatgaaacaaaataatacaacaaagaaactcgcacttgccggtgttctcaccgcgcttgcaatcgtcggaagctttatcagtgtaccggttgccggaagcaaatgtgctccggtacagcatatggtcaacattcttgccgccgtaacacttggtcctgcatggggcgttggcattgcattctgtgcaagtttactccgcaatctgctcggcctcggaagccttatggctttccctggaagcatggtcggtgctttatgctgtggtcttgtctacaaaaaattccacatcttaagtcttacctgccttgccgaagcgatcggaaccggattccttggcgcacttgccgcttatccggttgctttgtatctgatgggaattgcgccggcaggacttttcgtttatgtcgttccattccttatttccactgtcgcaggaagcatccttgctttcatcctgatcacagttctggaaaaaggcggcgttatgtcacagatcaaagaagcataatcatcattcattcttacagcactctgctgtaaatgaaaccgcgttacaccggggacaccaccttgtatcgcgtaataaaaggcagagattttcaaataaaatcctgttcattgccggaaattttccgacaaaggcgttagcaattctatcattccgaactggaagtgtacctatcaggctgtgtctggtttttttcgtgtacgctgtccgtgttttgctgacgccagatttttgtgatactcacatacaaatgatgttggggcaaaaggtattttgacccctttgataccagattgctacgtgcttttgaccctggtatcagacaaataagaaacggaggcaaaacaacatgagaaattacacaacccagatggacgctgccagaaaaggaattctgactccggaaatcgaaactgtagccaaaaaagaacatatgccggttgaaaaactgatgcagcttgtcgcagaaggaaaagttgccatctgtgcaaataaaaaacatacctgccttgatccggaaggtgtcggaagcatgcttcgtaccaagatcaatgttaacttaggtgtttcccgcgactgcaaagactacgatatcgaaatgcagaaagttatgagtgccgttaatctcggcgcagaagcaatcatggatctttccagccatggtaatacccagccattccgccagaagctgactcacgaatgcccggctatgatcggaaccgtaccggtttatgacagtgttattcattatcagagagacctggcaactcttactgcacaggattttattgatgttgtccgtcttcatgctgaggatggcgtggacttcgtcacacttcactgtggaatcacaagaaaaaccatcgaacagatcaaaaaacataaacgtaaaatgaatatcgtaagccgtggaggaagtcttgtctttgcatggatgtgcatgaccggagaagaaaacccattctatgaacattacgatgaaatcctcgacatctgcgaagaatacgacgtaactatttctcttggtgatgcctgccgtccgggatgtcttgctgatgcaacagatgtatgccagattgaagaacttgtccgcctcggagaactgaccaagcgcgcatgggatcataatgtacaggttatggtcgaaggacctggacatgtaccgctggatcaggtcgctgccaacatgaaagtgcagcagagcatctgcatgggcgcaccgttctatgtactcggacctctggtaacagatatcgctcctggatatgaccacatcactgcagccatcggtggcgctgttgcagcgatgagcggagctgcattcctgtgctatgtcacacctgccgagcatcttgcacttccaaatgtcgatgataccaagcagggaatcattgcttctaagattgcagcccatgccgctgatattgcaaaaggtatcccgcatgcacgtgatatcgatgacaagatggcagatgcacgccgtgttcttgactgggatgcacagtacgcctgcgctctcgatcctgaaacagcaaaggcaatccgtgacagtcgtaaaccagaagatgaccacagcgatacctgcagtatgtgcggaaaattctgtgctgtaagaagcatgaacaaagcacttgccggagaatatattgatattctgtaaacttaaagattacttgcaaaagaagagaatcggaaattatccggttcttttctttttcactaattttcgctctatttgttctataaaatatagcactttgccagtggtaaattttcgggtttgatgtataattattacacagcaaaaaggatgcaacgggagggaaaggtttatgaaaaataaaataatatggaaagatgttactcttattgtacttgctattctccttattttttctatgtgcagaatacatacactcaaacagtcgaacaaaaaactgtactcacaaaatctggagctgaatcaccagcttgccacactgaaagaaaagaatgcaggtttagaatcaaagctgaacagcgaagaaagtatcacagatgaaaaaaaatcagacaattctcaatattaaaaattgaggagaagtttccagatcctggattcttctcctcgtttttatttatccaatcatttaattaacagatctctgctcctgccggcatcttcttctccggtgtcatcagcgcaagattaccatctgcatcttctgcgcagagcagcataccttctgaaagcactccggcgagttttgctggtttcaggttcacaagaaccataaccttcttacctaccatttcttccggtgtatagtgtgctttgattccggaaacgatctgttttacctggcttccgatcttaacctgggagcagagaagctttttcgattttttcactgcttcgcaagaaatgatctcgcctacctggaactgcattttttcaaaatcttcgaaagtgatctccggttttgcttcgatgtcgattccttcttcttcctcttccttttcttctttaacctttggatgaagctcttctacttttttcatgacttcttccaggtcgagtctctggaacaggatttccggtttttctaccacatgtccgccaccaagctgtgccaggatcttttcagctgtttccggcatgaaagattcaagcagttttgcaccttcggaaatgctttggatcagattccacagaactgtttccagacgatccttcttgtcttcttcttttgccagtgcccaaggcatggtctcatcaatatatttgttacagcgtttgaacaaattgaagatttctgtgattgcatctgccacacgcagctccttcatttttgcttctactgcctttgatgtattttctgtcacagctttcagatctgcatctacttcttctgccacacctttatcagtaactgtaccgccaaagtatttatttgtcatagaaatagtacggtttacaaggttacccagtgtattggcaagatcggaattcagtctttctaccatcagctcccaggagattacgccatcattttcaaacggcatctcatgcagaacaaagtaacgaaccgcatctacgccaaagaaatctacgagttcatctgcatagagtacatttccttttgatttactcatctttccatcgccctgaagaagccacggatgtccaaatacctgcttcggaagcggaagtccaagtgccatcaggaagatcggccagtaaatcgtatggaaacgtatgatatcttttccgatcagatgaaggtctgccggccagttcttattgaacatttcatcgctttcaccatcacagtgatatccgataccagtgatatagttggtaagagcatcaagccatacataaacaacatgcttcggatcaaagtctaccggaattccccatttaaaagaagttctggatacacaaagatcctgaagtcccggaagaaggaagttgttcatcatctcattcttacgtgctaccggctggataaattccggatgtgtattgatatattcaatcagtctgtctgcatatttgctcatcttgaagaagtatgcttcttcttttgcaggctgtaccgggcgtccgcagtccggacattttccatctacaagctgggattctgtgaagaaggattcacatggagtacagtacattccttcgtagtgtcctttgtaaatatctccctggtcatacagtttcttgaatatcttctgtacttctttctcatgataatcatccgttgtacggataaatttgtcataagaagtgttcatcagatcccagattctcttaatctctccggatacgttatctacaaattcctttggtgtaacacctgcttcttctgcttttaattcaattttctgtccatgctcgtcagttcctgtctggaaaaacacatcatatccctgacttctcttataacgtgcaattgcgtctgccagcacgatctcgtatgtgttaccgatatgtggcttgcctgatgtataggcaattgcagttgtaatataatattttggtttgtctgccatgattctttatctcctttttctataaattaaaaatagtgcacatctccggcacgtagtgccttttatttaacaaagacttcctgttaaataaaaaaccgccttctataaaatatagaagacgggattattgccgtgttaccacttctcttcatccttccctcacaagaagaatctcaccgggtacagtctgctgtttttggcagtccatatctgcactcgccgctgtaacgggcggaacccatcgcatgcttgcacaggaaactgattcgttgcttccttatgttcacctgcgctgctcagaagccatcttcagtctttctccagccatccctctcagcctctgcgggacttctctgtaaacattcaaaagacctactctcttcgtcatcgctttttccatatcaaaaaaatcgtatcacagatatcagaaacttgtcaaggcgtatttgacaccagatagtctttttccttcaatacctgctcgatcagatccagtgtctcttccgaatccgcttcaactgtgtgataatgatagttggaagtgatattcttaagcggactggactttccactatggatcccttccatgaattctttgacatttctccgcgatgccacatcaagaggtgcttccatatgtccataaatccggtgattgatcattacatttaccaccttgcctcccagatccacgatcgaacaaagctcatcctccatctgttcatccgtatgactgactttgaacactctcgttaccgtatgcggtgcattcagaatatatccccggttggttgaaatgatatcatatccggctgcacggatcagcgcaatgtcctgtacaatgacctgacggcttacatcatataccttcgccagttctttcccgggtaccggaacctcactgctctttattttgctgacaatctcttctcttcgtctggaacctgtcatcccgatataactctcctttttctgcaattctgctctgtgcctgacgtattacagactttcctcttctgtctgccaaatcctgtcttcactcttgctgaatccagaccggcttaaatagcatgcagattcttcagcgaaatgtcaaggacaggagctgaatgggtaagtgccccacttgatatatagtctactccaagagacgtcagacggtcaatattttcttttgttacatttccggaacattctgtctctgcacgtccgtcaataatcctgattgcctccttcatatcctccggcgacatattatccagcataataatatctgctcccgcatcaacagcctcacgcaccatatccagattttcaacttctacctcaattttgcggacaaacggtgcgtattcctttgccatttccaccgcctttgccacacttcctgccgctccgatatgattgtcttttaaaagcactccgtcggaaagattatatctatgattatatcctccaccgacacggaccgcatatttttcaaaaatacgcatattcggcgttgtctttctggtgtccagaagcttcgtcttcgttccttccagaagcattgcaaccgaatgtgtataagtcgcaattccactcattctctgcagataattcagtgccacccgttcccctgagagcagcgcacggatatcgcctgtaataatccccatcaattctccttttttcacttcgtcaccgtctttacaatagaaatctgtcttcacattttcatccagaatttcaaatactctgtgaaatacatccagcccggcaactactccatcctgtttgcagatcagctgcacctctccagtcaccgcttctttcatcaccgcattggtggtcacgtcctcactggaaatatcctcctgcagtgcttcttttatcagatggtctacattcaatgtcatcgtaatcttattcatttcttttttcctcattctaaacagatttttttcttttatattgcctctttacagaacagcacaggatttactgcattttccactccggaaatcttatgtgccgcacgttttgcaaacaccaggctctcaagcagagaattacttgccagacggttcgccccatgaacgccattgcagctggtctctccaaccgcatacagatgctccatcgaagttctgctgtcgctgtctacccagatgcctcccatgaaatagtgttgtgccggaacaaccgggatccactcttttgtcacgtcatagccttcttcccggcaccgctcacagatatttgggaaatgctccaggatcgtattcttatcaatattttccatggaaagccatacatgatccgttccgtctttttccatttgttcccggattgcttttgtcaccacatctctcggaagaagctcatttacaaaacgttctccgtctttattataaagaactgcgccttctccacggacagattctgaaatcagaaatcttcgccccggttttgaagaatacaaagttgtcgggtggatctggacataatccagatgctccagacggattccatgcttcctggatatatcaagcgcatctcctgtcagatgtggaaagtttgtagaatgctggtatcttcctccgattccaccgcttgcaaaaatcgtatcctgtgcatagatcttcatctcttcaccgtctgccgtcttcgctaaaatacctgcacattttccatttttaacaattatgtctgtcatagttgtatattcgtgtatttgtacattttttcgtttctttacacgcacgagcagtttactcgtaatctctttccctgtaatatcttcatggaaaagaatccttggtctggaatgcgcaccttctcttgtaaatgcaagatttccgtcttttttagcgaaatccacaccatattcaatcagatcatgaataatttcctgcgagctgcggatcataatatccactgattctttcctgttctcgtaatgacctgcacgcattgtatcttcaaaatacccctcataatcctcatcatcccgaagtacacagattccaccctgtgccagaaatgaatcactgctttccagatctgacttggtaatcataaggatctgtttatcctccggaagattcagtgctgaaaacgctccaccaactcccgttccaacgatcactacatctgtcttaatctccaactttatccctccaattccggttctcttagccggtcacctgttgtttcttatttttgattttccggttcttttattttgcagcaagctcaagcattttctctaacggtttttgggaattttcccgaagttttgcatctacgtgaacctcattttcaccagtctgcaaaacatgcaatatcttctccagcgtattctttttcatattcggacataccggtagcttgtccggataataaaatgtcttctccgggttctgttccttcagcttgtaacccacaccctcttctgtacagacaataaattcctgacaatcacttgccgatacatactggatgattcctgatgtgcttcccacgtaatctgccatcgcaagaagttctgcacggcattctccgtgtgcgacgatctgtgcccccggatgtctccttttcacctcggctacatcctccggttccatccgttcatgagtcggacagaatccattgttgtaaacaaaatttttttccggtacatgatcggctacaaaatgtgccagattccgatccggaataaagaaaatattcttgttcggaagttcttttacgatcttcactgcatttgcagatgtcacacagacatccgagtattctttcagtgctgccgttgaattgatatagcagacaacagcaagatcatcatactctttccgcatcttccggatcgtctccacatctgccatatgtgccattggacagtctgctgtcatatccggcatcagaaccgttttctccggattcaggatcttcgcactctcccccataaaagaaacgccacaaaatacgattgtcttttcttggagcttcgttgctaccttgctcaggtaaaaagaatcccctatataatctgctatttcctgcacctccggccgcacataataatgtgccagaatgacagcattcttctcttttttaagcttctgtatctcttccaccgttgtcataacatgatcctcccttactgactcttttctcatctctgatcttttttcagcatagtgcacattatagcaccacactttacatctgacaagacacttgttttatttctgtaaagtttcgtttgagatacatatttccagaatcaaaatcatatacatagaaacaacatcatttcttctggagttttatgtttcatttaattcttaaacaccggaaaaaaatttttctgatccttccctgttgtctgctggtcattctgatttcttttctgtctggcaatgcattttggagctccctgcatgcagaatcctccgaccggcaattccgtactttcacacgtagtctcttccagacagaagtatccgcaaataccatcagccttcactataccttgcgttctccttctgactatggcatcgcggacatcccggctacatacggcagtctttcttctgattccgttgctgcaaaggcttctgtcagaaatgttctctcttctctgcaggaatttgatcccgacactctttcttcggaaaatgcactaacctttaaaatcctggatacctatcttaaaaatgcatctacaggaacagattatctgctttatcaggagcctctcggccccgtatccggtatccatacgcagctgcctgttctgctctcggaatacagcttttacgacacacaggatgtagaaacctatctggctctcttaaaagaaacgccttcctattttgattctgtcatccggtttgagcagaaaaaagctgcttccggtctttttatgccggattaccaagctgattctgttctggacacctgccagtcttttatcgatatgggtaaagagaattatctggtcagtacatttaacgaacgaatcgcgtcactggatcttttacctgaaaacaaaaaagattcttttcagaaagaaaatatgaaacttgtaatagaagagatttatcccgcttatcaaaatctgatcaccgctatcaaatcgctgaaaggaaaaggaatgaatgaacagggacttagccatttcccttatggaaaaaaatactatgaatatctggtgcgtcagactaccggctgcaatgagtccatttcccgtctgcgactgatgaccagggcacagatactagaagatctaagtgccatgcagaaggttctcttccctgctgacgcagcacttacccaggcatctgttttggagcagacatctcctgattccatgctggacgatctcaggtccaaaatcacagatacattcccggaaattcctgatgttgatttccaggtcaaatatgttccagaatccatgcaggattatctaagtccagctttctatatgatccctgccattgacaatttaacggaaaatgtcatctacattaacaacgggcagaccgcctcagggctgaatctctacacaacccttgctcacgaaggctatcccggacatctgtaccagaccgtctatttttctgcttctgagccggatcctattcggagcattcttgattttggcggatacgttgagggctgggccacctatgcggaaatgatgtcctactaccttgcacctctccctaagactgaagcatcccttctccagaaaaatagttctgtcattcttggactttatgcgcttgcagacatgggaattcattatgacggctggtctgtaactgatacagtccgctttttcagcgattacgggatcaatgatccaaacgcagtacagagtgtctataaactgatcattggaagtcctgccaattatctgaaatactatattggatacctgaaattttatgaattgaaaaaggagatggcagatgccatgggaaatcaattctcccagaaagaatttcacagggcggtactggatgtggggccggcgccatttgagatcgtatatgatgaggtggaaaaaaatttattagattgatcctatttcacacaaaataaaactatcctgtgagaatccgaaacattcccacaggatagcccatcaaacacattttatataatttacacttgaatctacagatccagtttcagatcattttccttgatccagccacattttctcatcggaatcgcaatcgcccaagaaagcactgccggaagaataaaacagatcagcaccagacctgcccagtccattccggtgatcgcagctttggttccttctgcaatatcatttacccagccagtgtacacaccaatctgtccgaccagtccgcaggttcccattccggatgccactgccgcaccgttcatcttcaaatggaagatacaggttgcgaccggaccggtaattgcggatgccagtgtcggcggaagccagattctcgggtttctcacaatgtttcccatctggagcatcgaggttcctattccctgtgcaaaaagaccaccccatttattttccttaaaactcataaccgcaaaaccaaccatctgtgcacagcagccggctacagcagcacctcctgcaagcccggtaagtgaaagtgccgcacagatcgctgcactgctgattggaagtgtcagcgcaataccaacaattacagatacgataattcccataaaaaatggctgtaattcagtcgcccacatgatcgcagttcctacggtacttgccgctgctccgatcgccggtgcacatcccagtgaaagcagaacccccacacagatcgtcacaaatggtgtcacaataatatctatttttgtttcttttgaaaccagttttccaaattctgctgcaaaaatcgtaacgaccaaaaccgcaagaggtcctccggcacccccaagttcatttgctgccattccgactgccgccagtgaaaacaatacaagtggcggacattgaagtgctactccgatcgagattgccatcgcagctccggttgctcctttcgcataaccgcctactgttacaaggattcctataccaagctgttctccgagtgtgctgatgatcgtaccgatcagaagcgatgcaaacagtccctgcgccattgcaccaagcgcatcgattccgtatcgcttcgctgaaaagataatatttttctttcttagaaactctttcataactttctcctgctcctgtcattcttttagtgtataatctactgtcttgtcacatgtgattactgtgcaatattatccactgttttgtcagatccgtcaagaagattttatttaaatctcttatcttcgcaaaagtatgatataactgatatgactaaaaagtaggagtgtacattttttaactgcacactcctgctttttatttcttatttttattctttatgaaaatatacatgataagcttccatatctacttttggaagagggatcatcttcattccattcgcttcaaactgtaattttccatcaaccatatgaatttcttctactgccggtgctgtaaggaattctttttcctctgaaagtgccgcaagaatatatggcccatatgcaagattgacaaatgccgcatcagacttgttatccaacacacggaattccatcggaagttccagtcggatcacatctccggctttcgaatctgcatcaattaccatataaccatcatgaagtgctgtatctgcaagaacttttccatttacagacacgttaaaatccttctgtccccatgccggaatatggattttaagaacttttttctgatccttttggcaacgtatttccattacaccttcttcatccacactctgaagttcgatcatcgcttttccattttcgtccgtcagcacggaatctacaagaaggttaatgtaaagcgcatcttcatcctgcgcataaatattttccatatagcggaatctgctctccataccggttccatgacagcaggaattctctgaaaggaagaattcttttctgccacccggaccaagtggaagaaaataagtcgttccaccatcacatttatgactacttgatgtcaggatatgatttctcagcgtattatcataataatccatcagattgccgcttcgcgtatattcaaataactgactggtcaggcgcagcatattataacttgcacagctttcagcagccttatccgtaagataagaacacgttgtatttgcacgatggaacatctcagtctcaccaaccccaccgatacaatatgtatgtccgccagtcacgatattccagaaattctttccgatttcccaataaatctcatcaccagttgcccgatacagatccattgcaccgataatctgcggaatatgctggtttgcatgcatatcctccaatgtatcgcattcttcttccatcggatagaataacttttcattttcaaaaagttttgcagccttcagatgattttcttttccggtcagttcatagacttttaccattgttccaagcataccaccaaactcacctgcaatatacattgcccacattttatccagtgtttcttttggcagacgggaaagtctgtcatatacccagtctcccatcaagtccaagatctcttttgccgtctcatttccagcaagtacatgacaatcatataatccagacataatcttatccaaagtataatacggagcccagatttccggatacttggtatatacttccagaagatcgaactgttcctctgagtatgcacttaaaaatcctctgtgatatttgccggttgccgcaaatgcatcctggcactttttcagctctgctaccatgtaattgactttatctaaaaattttggattgccggttgctgcaaatgcaagtgcaatacctgacagataatgtcctgtcgtgtgccctttcagtttacagctttcctcatcccaaccggtcatcggaggtgccccttttgtatccagtccggtcgctttgcggaaattataaagcatctggtcatcgtcaattccaagaagatattcttccatcagcttctggtatttataataaagagttccttctttcaaccgaacctgtccaagtggaaaataacccacttttttctccggtccctttactggtactatttcctttttataatggatctctgcagatgcttccttttctgttccatcgatcacacctgcaactgcaaccactgtctcttcttttgccggctcatatgtattccatttcaccggcattgtcatgcggcgtccatcttctgtatatacgatcacaacagacggaagatgtgcttcttcaccgaccagtgcattaagaacgactttacgtacttcttttacgatattttcttttgcttcctgcaatatggtcgccacatattctcttgactcactacgtccttcatatgttgcggtaaccgtcagtgtaactttacggtttcccatgccatgcagcggacgatgtacctttcctgtattgtcaataaatctttcttcccctgtctcccaggtaaattgagcaccgtattttccattctccgggagtgtaagattgtcatctactgtgctcagattcccaatataaattgcatccaaatcttttttaataatttctgctgcgttcatgttttgctccttttcgtataaaaattggattcgaaccatctatagactatattctatgtttctctccattctttgtcaagattttgcacattttttgttaattgtagtcatttttattgtgcgatatatacatttttcaaaaaaatctgaatacaacattcgataatttttatatacaacttttatttatacaagtaccgccagccacacactcgctgcaagccctgcaaatgttgcaataagtgctccggcaagagtatacctggtttttttcacctttgctgacataaaatacacagacatcgtatagaaaatcgtttccgtacacgccatcgaaattgaagcgatcattccgtttctcgaatccgttccaaattccttgtagatatcaagcaataatcccgttgcggcagaggacgaaaacattttcacaatcgtaagcggaaccaatgcccctggaaatccgatctgctccgtcacatttccaattatttccgatataaattccagaaaacccgatgcacgcaaaatccccactgccgccatcaatccgatcaacgtcggcatcagccgcacgaccgtccaaaatccacgctttgctccctgaataaaagtatcatatacattcactcctgcaaaaattccatatataagaatggacaaaatcataaaagggactataaagtcagatatgtataaaaaaaggcgcataaaaacagctcctggcgaaccactttactaaaaagtatattcgccggagctgttattcattccgtttgctttataaagaaaacttttctattcctcatccgcatacttcgcaaaccgcttctcattctgatggatcacataataatacatcacgatcagcaacgcacttgccaggatccatgccgccggacttgccatgcatactccaaagtaactcttctgccctgccgcgatcatggcaacaacgcccctgccaaccaactcagccacaccagccatcatcgggagcagtccatatcccattccctggattccattccggtaaacatttacaacggtaagcggaataaagaaagtaccgacgcatttcagataaatatccacggaatgcataatttctgtcaaatccccagacaagaacagatacgtcatatatttcccaactgtcataatgatcgccgcaactacgactgaatagatacttcccatgatcgtaattgacttaaatccctgacggatccttttgatcttacctgctccaatattctgtgcgcaataggttgccatcgtggttcccatcgcaacatatgcctgcgtcacgatctgctcgatcttattcgctgcggtaaatgctgctacctgtgtggagccaagcagattcagggcagtctgtaccatcatggttccaatcgctgtgatcgaatattgaagagccatcgggattccgactgcaagctggatcttcagcagatgtccgctcggacgccagtcctccttatgtaaatgcaggattggaaccgccttcacaatatataccagacacaggattcccgaaatcccctgtgaaatcacggtcgcccatgccgcaccggctgcgcccatgtgaaacgcaatgataaataccatatccagcacaatgttgagcaacgccgcaagaatcaggaaatatagcggaaccttgctgttaccaagtgcccgcaagacactggataaaaagttatatagcatctgcgccgcaattccaccacagattaccataatatacgcataggcatccttgaaaatatcatccggtgtcttcataatcccaagaagcggtttcattgccatcattccgagcacagtcataataagagacataataatcgccagaatcgcggcatttcctacagtcttgcgcattgctttcatatcacccgcgccaaatttctgtgccgtaagtacggtaaatcctgccgtcattcccagtataaatccattgatcagaaacatgatcgttcccgtacttccaacagccgcaagtgctttggttcccacgaactttcctacgataatcgtatctgccatactgtagaactgctgaaatacatttccaatgaagatcggcagtgtgaaattaaaaataatttttcccggattcccggtcgtcaaatctttctgtaatgttttcatatattccctctgtttatcttattaacattttacctttcgtcattatagaaaaatgtatcttaaattgcaattgtcgttttcacgaaatttcccctgtttcacaaagtatttcccgtttatttgacggaatctttgacaccccagattctatcctctataatagtttatatagaaaaaaattatcattttcaggaggcattgatatgaaaccactgccctttatcatgcaatatgtcaggcgatacaaatatcgctatattgccggaatccttactctttttgctgtagatgcggcaagtgtatttattccaaaacttaccggtatcattaccgatggtcttaccgcgcgtagcatcacctggagttccattcgtacctgtcttcttggaatctttctgattggtcttctgctcgcagtcggccgttttttgtggcgttattttctttttggaaccgcacgtattatcgagcgcgaactgcgtaatgaaatgttttcccatctggaaactatggatgtggaatactacaacagccacaaaacaggtgatctgatgacccggtttaccagtgacttaaatgcggtccgcatggcacttggccctgctgtcatctgcatctttgattccgtagtcatgacgctcctggtcgtctgccagatgatgtattatgtcaatataaaactgacccttctggcactgatcccgatggtcatcatctgcctcggctatatgcattacggaaaggtactggatgacctctacaccgaacgtcaggacagtgtttccaatcttgccgactttgtacaggaaagcttctccgggatccgtgtgatcaaggcctttgttcgcaagcaggcagaaatcctttctttttccaaaaagaaccaggataccatggataaaagtatgcgcatcgcaaagctggaagccatcctgatcccgcttctggatgtgatcatcggattttccagtcttgcctcactcctttatgggggatacctcgccctgatcggacagattacactcggacgcttcgtagctttcaatcagtatgtcaatatgctggtatggccgatgctcgcctgttcggaagctgccgtcatgttttcccagggaactgcatccatccgccgtgtacaggaaatcctggaagcacagacaaatgtaaaagatactgcttctgtcacaactttagataccctgcacggggatatccgttttgatcacctgacctttacgcaccttggaaatacttctccggtactgcatgatatcaatctggacatcccatccgggacaacccttgccatcatcgggcgcaccggcaacggaaagtccactctggtcaatctcctgctccggctttacaacaccgagccaggcatgatttatctggatgaccatgatatcaacacaattccgctgaaaactctgcgtgaaaatattgcttatgtaccacaggataattttcttttttccgatactctgaaagcaaatattgcattcggtacaaaatcacaggatatgagccgtattatcgccgcagcaaaatcagcctgcattcacgataatattgcaaattttccggacaactatgatacgatcgtcggcgaacgtggcgttacgctttccggcggtcagaaacagcgcagctccatcgcccgcgccctgataaaaaatgcaccgatcctgatccttgatgactccctttccgctgtcgacaccgatacagaagaacatatcctacataatctcagggacgatcgtaaaggaaaaacaaccatcctgatcgcacaccgaatttccacggtacagcatgccgatctgatcatggtacttgaaaacggggaaatgaaagagcttggaacacacaccgaactgattcagaaaaatggtatttataaagatatgtttgaaaagcaacagttggaagcttccattggagaacaggaggtagccataagatgaaacgacttttaagttatctaaaaccgcataaatgggtaatgaccctggcaactgtcctggttctctttatcattgcggtggaactttaccgcccgatcatcatcggaaatgcaatcgaccagtatatcaacggttattatcatccgtatgtagaagccgacgtttccgcttcggacgctgtaaactggaacggtcttgtactgtcgcgcgaccaggcagtatctaaggcggattctgcttccttttatcagatttttctctggaaggatcactattacatggcagaaaatctcacccgcgctgaatgtactgcactacaaaatgccgatacatctgttttaaaaaattatgtcagagaaggtgcacagaagcttacttccaacgatctgaaggttttaagacaaaatgattttaaggggatcttaaaagccggaatcctgtttcttctgctgctttttagcggatttttcctgaaccttgccgacacctggcttttacagaagatggggcagcagatcgtgtacaaactgcgtgaagaaacatttacacatatacacagcctgtcactttcttttttcaatacaacaccggttggcaagctcgtaacacgtgtatctaacgatactgaagcagtcaacgaactgttttccaccattcttgtgaaactttttaaaaacgttgttaagattattggttacgctgttgtcatgctctcaatcaatgtgaaaatggcaagtatatccttcctgcttttacctctggttgcaatcctgacttttgttttccggcatctctccagaaaagcttaccagatcacaagaaataaaatcacagagctgaacaccttcctgtccgaacatatttccggtatgaagctgatccagatctttgcacgcgaaaaagagaaatacagtgaatttgaaggcaaatctatggaactgtaccgtgccaatttccgcgagatcatgacttttgcgatcttccggccttcaatctatctggtttcggtcattgccatgatccttgttatccgtaccggaagcctttctgtgttaaatggaagtctttctctcggaaccctgttcgtgtttatcacctacatcagctccttttttgagccaatccaggagctttccgaacagcttggaaccctgcagtcttccattgcttccgcagaaaagattttcagtgttcttgatgtaaaaccagagatcgtatctccagccgatccggctccggtcaatattcttggtgaaattgaattccgccatgtctggtttgcctacgaagaggaaaattatattttaaaagatgtaagttttgtaatccatccgggtgaaaaggctgcttttgtcggcgctaccggagcaggaaaatctacaattttaaatctgattggaagatattttgatattcagaagggacagatcctgattgatgggatcgatattcatgaaattgatctggatgtactccgcggtgcgattggtcaggttcagcaggatgtcttcatcttcaccggagacatcaaaagtaatatctcgctgaataatgaagcaatctcaccggacgatgtcagacgggctgccgaaattgtaaatgcagatccatttattcagaaactgccgcacggatatgatgaaccggttacagaacgcggaagtactctatctgccgggcagcgccagcttttgtccttcgcacggacacttgcttatgatccgaagatccttgttctcgatgaagcaactgccaacatcgatacagaaaccgaaacactgatcacacaggcacttgcacggctgatggatggaagaactacgatcatggtcgcgcaccggctttctacgatccagcatgcagataaaattattgtgatgcatcacggggaaataaaagaatccggaacccatcaggagctgctggcgaaggatgggttgtataagaaattgtatgaattgcagttgatggattaagaatccgtaaattagtgaggacatctcagataaaataatccctgccaattccattgtgcaaaccattccgatgaaccacttagagcgaaaatcgtgttcagcagaggcttccacgatttttgtgtttcatctccattgcacaacaagtgaattggcagggattattttatctgagatgtccctttagtttactggtaaatcttttaggtcgtctcccgttatcattttttatcaattgatctacaagatttctttcgccctatggcatgcaacggaatgtcctttggaaatctcctggagtttcgggacaccgtttttacaggcttctgtcgcatatggacaacgagtcacaaaacggcagccctccgggatattcatcggacttggcagctcgcctttgagctggattcttttatgtgctaaaacctcgttcctgttttctactattatttcattttcaaaatattctctacgacaacatcatccggtcattcgcaaactcgccgccgctgacttcttcaaacttcgccagcagatctgcaaccttcagattctttttctcttctcctgctacatcgtagataatttttccttcatgcatcatgatcaggcggttgccgtgcgcgatggcatctttcatattatgtgttaccatcattgcagtcagctgatgctcctgaatgatcttatcggagatggcaagcaccttcgctgcagttttcgggtcaagtgctgcagtatgctcgtccagaagtaaaagctttggctttttaagagacgccatcaaaagagtgatcgcctgtcgctgtccaccagaaaggagtccgactttactgctcagacggtcttccagtccaagatcaagttctttcagggcttctttatagcgctcccgctcttttttcgtaatgccccatcccagacctctgcgctcgccacgtctggctgcgatcgccatattttcttcaatcgacatggttgccgcagttccagtcatcggatcctggaaaactcttcccagataaagtgctcttttatgctctgaaagctttgtaatatccactccatcaatgatgatctttccttcgtctacagaccacactcctgcgatcgcattcagtgtggtggattttcctgcaccatttccaccgatgatagtcacgaaatcacccggattgaggttcagattcactccgttaagtgcgaccttttcgttgatcgttcccggattaaaggttttatgaatattctggatttccaacatatatcccattatgcagtcctccgtttctttgttaaatatttacccttcatgtacggaactgcaaggaagcatgcaaccactaccgctgagaacagtttcatataatcagaaggcatcttcagccacaataccagtgcgattacaatatagtaaataatcgctccgataaagattgctcccagtgtaaatgcaaaggctgcttttctgcctgcacagaattttccaaaaataacttcgctgatgataacggctgcaagtccgattacaatggcaccacgtcccatattgacatcggctgctccctggtactgtgcgtaaattccgccggaaagtcccacaagtccgttggagatcataagcgccagaacctttgtaaagcctgtattaattccctgtgcacttgccatctgcgggttacatccggttgcacggatcgatgcaccaagctcagttccaaagaaccagtaaataattgcgatcaggataagtgctgccacgatcagttttacaaaaaacagttcacttccttcgccggtcacataacgaagagatgcaaccaatttatactgcataacattgactgcctgattggattttcccatgattccgagattcaccgagtaaagtccgatctgcgtcagaatactggccagaatgcccggaattccaaaaaacgtatgtaaaatacctgtcacaaatccggctgccatacctgccagaaatgcgaaaagaagtgccagtgccggattcataccgccgcggatcagcataacagcgaccgctccgcctgtcgccagtgatccatcaaccgtcagatccgcaaaatccagaatgcggaaggtgatataaacgccaagcgccataattccccagatgatcccctgcgctacatttcccggaagtgcacgcacaagagacatcggatctaaagctgctaaatacattgttcttgcctctttctatactgattattcctcaattgcttcgtaatcgtccggaacagtgattccgagttcgtcacaaattgttttgttatacatctttgtaacattcggtgcactttcaatatccatggttgagatatcttttccatttacaaggatatcgtaagccatttcacctgctctgtatccgatgtcatagtaactgatagaaagagttgcaataccacagccttcacagattccctgttcacctgcgattaccggtacttttgccggaagacagatattgttgataatctctgtattagatgccattgtattatcagttgggatgtaaagtgcgtcgcactcatctactgcacttgttactacagactggatttcattagagtctgctgctgtgtattctttatatttgattccatctttgtcgagtgcttcttcgaacttcttagcctgatatgctgagttcggttctgctgaacagtagaggattcctactgtttttgcatccggaaggagttctttaagcattgcttcctgttcatcgatcggtgcaaggtcacaggttcctgaaatgttcatacctgttgatcctgtccagtcagaaatatcaagagcagttgcataatctgtaacagatgttccaagaatcgggatcgtgcttgttgcagctgctgcacactgaagagcagttgttgcatttgcaaggatcaagtcatcattatctgccacaaaattgtttacgatggttgcgcagtttgcctgttcgccctgtccgttctgaagatcgaacttcactttgtcttttccgaatttttcttcacaggcttcttcaaatcctttggttgcctcgtcaagagctgcatgctcaagctgctggcagataccgatcttatataccttgtctgatgaatcctttgaagaagattctttgtctgatgaacttccgccacaggcagcaagtgccagtgtcattgctgcagtaagtgatactgctaaaatttttcttgctttcataataacatacctccatctatgttcttttcgaacaaactttttccgttttggctttacagctttaaactttagcggtttaaacttcaatggtttaaagctttgccgtgatattgattatagcgtttttttgtactttagtcaaggtatgttacaaaaagctacaaaaattctagcttttccggtccattatcctgcaaaataaaatcgccgccccggtactgaccgccgttgccgcaatcccaggtccaacaacggctgtcggattcacgcttccgtactggctccggtaggcgatcaccgacaccgggatcagctgcagtgaagaaatatttacgatcaggaaggtgcacatctcattgcttgcaacgcctctttttcttaccggtcctgccgcttttccaaggcggcggtcttcttccagcttctgaagctcttccattgcttcaagacctgccggagttgccgcccagccaagtccgaggatatttgcaatgatgtttgccgcgattggtttttctgccgggtgatcttttggcagttctggaaagaggaaatggatcagaggggaaaagcggacggttgccgttttcaggatgccggatttttctgcgattcccatgagtccggtccagaaggacatgacgcccatcatcgtgatgcaaagggtgacggcttctttggaggaatctaaggcggcggtggtgatgtccggcattttgccagagaaagcggcaaaaaggatgccaataagaatcattcccgaccacaggtaattgagcattttttctcctttcttggatggggaagagtgttagagaggggacgccgggtggaaaataaattgtgttcaaattcaagttgtgcaaaccattccgacgaacctcttagggcgggaatcgtgttcagcaatggcttccacgattcctgagtttcgtttccattgcacaaaaaattgaatttgaacacaatttattttccgcccggctgacattctacaagtcatacttttccgccaaactataaatggggagtcgaaaagcctgctctttgagattgcatctcaaagttgcaggcttttgctgcgattttcgatacatttatatgtagaaaaccatttctttattcaattatctttctcaggatgttcttttttgtataactctttcattcgattaatttcttctacagtatattcttctacctctgtttttgtcactctcttaatatgttgtcttttcaggcgtaagtatacatattcccggaagagggtgtagagtacggataccagcgggatgaatatgagcattcctatgattcccagaaggttgccgccgatggtgactgcggcgaggacccaaatggagggaagccctacggagctgccgactacgtgtgggtagatcaggttaccttcgatctgctggaggatcagaaatacaaggatgaaaaggattgcctgtttcgggctcaccatgaagatcaggaggccgccaagtacgcagccgatgaaggctccaaagattgggatcagggctgtgaaggatatgatgattccaatcagcagtgcatacggcattttcagtatacttaatgtaattacaaacatacttccgaggatgactgcttccaggcactgtccggtaaggaagtttgcgaaggtacggtaggtcagggaacagacttcaagaatcacttctgcttttcgttttggaataaacgcgaaaaacacttttctcacctgcacatgcagtttttctttctggaaaagaatatagcaggcaaaggaaaaggcaataaaaaatgtagtaactccactgacgatggatccaactgctgtcatcgttgtattcataaaatttcccgcaccatttccgagaatactcatcccccactggattgccttattcggattgaactccacctggttcacaagatccatgatttcccggttattgtgcgtaaattcccgtacccagctctgcatctgcggaataaaatctgcaatactgttcatcagacttccaattgttgccgtaagctgcggaatcagaccgaacataacaagcacaatcacccccactaccagtacgatcgtaagaagaagactgatcggtcttgcaagctttcctgccgccttacttcctttctcttttgcctttccaaataattttttctccagaaagctcatcggcacattgatcacaaacgcaatcgcaccgccaagagcgaaggggaaaataattccccataccgccttgatcacgccgagaaccacatcaaatttccacaatgcaactacgatcagcgctgtaaatacgatcagttcccggattttttttatagataatttactaaaatccactattttctccattctactacaatatatttatggttaatccccttacaaccagtaagcattttcccatattgttactcagataattttccacgtacccacttcagaagctgtatgatcggaaaacaggcaaatgcatacaggtagacagtcccaagctgttcaaagttcaatgtttctactttgaacacctgatgcagccccggaattgtaagtacagccgtgatcagaattgcgcccagtgcaaatgcgccctgcatccatttattattgaaaaaccgtttggtaaaaatcaccggatgatctgatttacagttatatccgtgaaacagccgtgcaagacagagcgttccaaatgcataagtacttccaagaagtgcaccgtcctgatgatatcctgtcaggaaactgatcatcgtcattacaccgatcaccagtccttccagaccaatctttgtcaggaaatcttttgtcaggatcgactcatctgccggtcttggcttctcattcatcacatcactggtatgcggttctactcccagtgcaattgccgggagactatcagtcagcaggttgataaaaagcagatgaaccggtgcaaacggaaccggaagtcctgcgatcgatgcatataaaacagcgagaattgcaccgaagtttcccgataacagaaactggatcgcatacttgatattacggtataagtttcgtccgttttccactgcttttacaattgtggcaaaattatcgtctgtaagtaccatcgccgctgcatctttggcaacttctgttccggttactcccattgcaacacctatatctgcctgcttaagagccggtgcatcgttgacaccgtcgccggtcatcgatacaatatttccgcgctcttgccatgcacggacaatccggatcttatgttccggcgaaacccttgcatagacagaaatcttcgggacaaatccccgcaactcctcgtcactcatattttcaatctccgcgccctcacaggcttcggataaatcctttaaaatgccgatccgttttgcgatcgctgctgccgtgatcttatggtctcccgtgatcatcaccggacggatgcctgctttgatacattcttctactgcagcttttgactcttccctcggcggatccatcattgcgatcattcctagaaataccaaatggtcctcatcctctgcggtcagcagatgttcttccggaatctcccggaaggtaaatgccagcactcgaagaccttccattgaaaattcctgattctggctctgaatcttttctttatcttcttttgtaatctcccgtattccattgtctgtccagatccggtctgtcagatccaggagacggtcaaccgcacctttgacgatcatccggttttcgccgtctatccggtgaagcgtcgacatcattttccggtcactgtcaaatggaatctcatcttctcttggataactttctcttacttctgcagcttccactccatagcggcttcccagattgatcagcgctgtctctgtcggatctccgatttccactccattttcattggtagaatcgttacataaaatgctacaatcaagcagaaatctctgtgccggatctgccatatcgatctcatctgcccggattcttctgccttctatataataatcttcaacagtcatcttattctgcgtgagagttccggttttatccgaacagatcacggagacacttccaagaccttctaccgcctgcagttttcgaataattgcatgctccttggccatcttctgcgttccgaaagaaaggacgattgttacaattgaacttaatgcctccgggattgctgcaaccgcaagtgctactgcaaacataaacgcgcttccgatattttctccacgaaatacactgattccaaataagattccgcaaaataccaggatcagaaccgaaagcttctttccgaactcttccagattcacctgaagcggagtctgcttttcagaggttgctttcaaaagtccggcaatctttccgacttctgtctgcatacctacacttgtcacaacggctcttccacgtccgtaagtaacaaagcttcccgaaaataacatattgttccggtcaccaagcggcacttcctcttcgatttcatccaggctcttctcaactgcaagactctccccggtcagtgcactttcatcgatcttcagacttgcgttctcgatcagtcgtccgtctgccggaacataatccccggcttccagaaggatcacatctccaaccaccagttctcttgccggaatcggtgtcaccgtaccattcctgagaaccttcgcctccggtcctgaaagctttttcaggctctgaagcgactgctctgcttttaccgtctgcacggttcccaaaatcgcattcattgtaatgacgatcacaataactgccgcactttctgcgtctcctaaaattcctgaaataatcgccgatgcaatcaggataatcaccaggaaatccttgtactgctccataaaaatctgcagcacactttttttctttccctccgcgagctcattccatccacatttttcacgggacttttccacttcttttatcgtaagtccctcttctctgcttcccatctgtccaagcacttcttttaccgatgactgataaatttctttcatcctttccgcctcctgtttctgagtattcacattcctgaatttcttatgcaacgaagctctctttcgataaaaatgtacaaaaaaagaaacccttattgcacaacaaataatgcaataaaagtctcaccattttcttgtggtaccggatgcttccaccgtactgacgacaccacaaacgcggattcccttgcgtaggttactcccctttattaacgtaactatataccacgaatagcccgattgtcaagaaaattttaaccggagtctccaaaatcggaaactccggcaaataatttcacatcttagtttgtaattgtcttttctgtctctttgtcgaacacatggatcttttcagcatcgaatgcgaatgtaactgtatcccctgttcttgctgttgttctagaatcaacacgggctgtcattgtagctccttcataatcaaagtggagataaacttcagcaccaagcatttcatatacacggatcttagcctgaataactgtattcggtgaagatgtgataaacatctgctcatcatgtacatcttccggacggattccaaggacaacagtctttccttcatatcctccatcgataagtttctttgcttttgccggtggaagtacaatatcagccggtccaactttgaggacaactttgtcacccttcttctggcatacagcatcaaggaagttcatctgtggtgatccgatgaatcctgcaacgaagaggttgcatggggtatcataaagtacctgtggtgtatctacctgctgaacaacacctgcgttcataactacgattctggttcccagtgtcatagcttctgtctggtcatgtgttacgtagatgattgttgtaccaagtctctgatgaagtttggaaatctcgatacgcatctgtccacgaagtttagcatccaggttggaaagtggttcatccataaggaataccttcgggttacgaacgattgcacgtcccatagcaacacgctgtctctgtccacctgaaagagcttttggtttacggtcaagcagtggttcaaggtcaaggatcttagctgcttcacgaaccatcttatcaatctccggtttcggaacttttcttaatttaagtccgaatgccatgttatcatatacagtcatatgtgggtacagagcatagttctggaataccatcgcgatatctctgtcttttggttctacatcatttaccactttgtcaccgatcttgagttcaccgcttgtgatctcttccagacctgcaaccatacgaagtgtggtagatttaccacatccagatggtcctacaaaaatgataaattctttatcttcaatttcaaggttgaaatctttaactgcttcaaatccgttcggatatgttttgttaatatgctttaatgataagcttgccatttatttttcctcctaaatctttgtgcgcttcttacacactgtcgctgttcttgtttctgaaataaagtatatctgtttttacatcgtcggtctataaccgggttgaacaaagattttttaagaaggtgtacaaattgacgaaagccttacagcagttctttataaatgtccctctttccgactccgcggtcttttgccacctttttcatggcttctttcttatcgattccctggttcatatagtaatccatatgctcctgaaccgtcatttcttcccattttgcgcgctcctcctgtaaaatgctctcccggctcttcccctcgatcacaagcacacactcccccttcggatcgttgctctcgtaataggaaaccgcttccgcaaatgtggtgcgaaatgcagtctcatgcttttttgtaagttcccggcacacagtcagatgtctgtccccaccaagaacttctccaagctctctcaaggttctcaccagacggtgcggtgcttcgtaaacgatcatcgttcttgtctcatctacaagctcacctaggactgcctgtctttcctttttgtccgttggaagaaatgcctcaaatgcaaatcttctggtggaaagcccggaaagtgtcagtgccgtaatacaggcagcggctcccggaagggaagtgaccgtaattccggcttcatagcacattttcaccagttcctcacccggatctgagatccctggtgtaccggcatcggtgatcagcgcaatattcatccctgtaagaagtttgtccaccagagcgtgtcccttttctatcttattatactcatgataactggtcatcggtgttttaatctcaaaatggttcagcagtttaatactgttcctggtatcttctgccgcgatcagatcaacttctttcagcgtccggatcacccggaacgtcatatcttccagattgccgatcggtgttgcacacaaatataatgttcctgccattcgttactcctttccagttcctgtcatcccgtaatactccaggatctcccgtgtatagctgccgtccttctcataaacgatcagtggcggatctactgtcatccgtgatttggcaccacggattccttctattaaaaccatgttcggttccttatccacatatggatacaccagacgcattctttttggctccagcttcgcctcacacattgctgtcagaatctctgcgagcctaaacggtctgtgtaccatataaaatcttcctccagcttttaaaatccgtgcactttcccggataatatcctccagtgtgcacagtacctcatgcctcgcaattgccttagcactttccggattagccattccatgacctccgatcatgtatggagggttcgttgttatcacatccatggaaccttttccaaatatctgtgacgcttctttgatatctcccgtcacaatgtcgatctgctcctcaagccggttgtgccggacactccgacacgccatatccgcactttcttcctggatctccagtcctgtaaaatgctttccttttgtctttgcagccaaaagaatcgggagaattcccgttcctgttccaagatcaagaacgcattctcccgcttttactttggcaaaggcacttaaaagcactgcatccattccgaagcagaaccgccccgggctctggatgatctcatagccttttatctgtaaatcatcgagccgttctcccggcttaagattatttgtcatctaactttgacgctccttcacctttctccagagctgcaagctctttcatttcctgtttggaaagcttcacatcctttttccgacggcgcggtttgaacttcaggtcagctgccggatattcacggatttctttctcatcattgtccagagttacaataaccctgacaagctgacgcagtacgcttaatgactgtacttcacctttcagtccttccggagttgtcaccgcctcacctgcagacggaagattattgttgagttcctcgtatgtctcttcctcatttgtcaggcagcacatcagtctgccacatacacctgaaatcttagtcgggttcagagacagattctgttcttttgccatcttgatcgaaaccggtgcaaactcagacagataggtgtggcagcaaagctctcgtccgcagatcccgattcctccgcggatcttcgtctcatctcttacaccgatctggcgaagttcgatcctggtacggaataccgctgccagatcctttaccagttcacggaaatcaattcttccgtctgcggtaaagtaaaacagcactttattgttgtcaaaggtatattctgcatcgatcagcttcatctccagtccatgcttgtggatcttttccagacaaatctgaaatgcttctttttcttttttgcgattcttttcttctacacggcggtcatcctctgtcgccaggcggatcaccgtcttaagaggctgggtgatctcttcatccttcacttccttcggtcccatcacaacgttaccgaattctactcctctcgcggtctctacaattacctgatcgccacgcttcacctcaaatttgcccggtgagaaaaaatagatctttcctgcagtccgaaaacggactccaattacttttgtcattccctagttctcctttattgtcaacagaagaagttccatgacaagatcaaagttgacattggcgcgcagtctcgcctttgctttctcaagtgcttccagaattgtctcaattccttcataagagctctttttcgcacgctccctgatactgtcgatctcttcactgaaaatcagtctgtcgatattcattgttgctttatagatcagaacatcacgataccagatcataaggatgtccagataatctgtgatctcaatcttgtaagcggaaatccgtttcacagcttccaccagatcaccgagttccatggtatcgatattcttcagcagacgaactgcctcatctttaatttcattaaaatgctcagagcctgccagcatagcagcttttccaatattgccctgtgcaaatgcagtacacacgtctgccttgtaatcaggaacctgaagctgctccatcagataccttttcacaagctgatccttaatgttacggagcttcagcataacgcatcttgagcagatcgttgggagcagactgttcgcattctctgtaagaagcagaattaccgcataagcaggtggctcttcgattgtcttcagcagagcattctgtgcctgtacagtcatcatatctgcatccggcacaatgtagatcttgtattttccattataaggcttcacctgaatatccccattgatctgaacccggatatcatctacactgatgctgttcggcttttcatgcgttacccagataatatccggatgattgccgctgactgcctgcttgcacgaatggcactcatagcacggttctgctccgcccttttcacactgcagagtctgtgcaaaaagacctgcaagcatcttctttccagatcccttctcgccgttcagaatataagcatgtgatactttatcttctataactgcgttctgtatatactgaatgatctcgctatgtcctacgacatctttaaatcctgacatattatcaccctcttctttcttactattccattagtataacataaatttatgcagatacctagagcaaattcctgtggtctttctgaattatttctgaaaattctgcgaatttcgctttgtaggtatgttgaaatcatatcttctgcacacaaactatcttctcaataataaaagatgacaacttttccgatatgttttataataagcatgaatatataaagcttctgtatccaatgatgtaatcggattgctccatttccacgcaatttattcttttgatacttacatcatacaagatgttggggtcaaaaggtattttggccagacaaactttatataagtttcttacacagaaaggggatgaactcatgctggaggtaaaaaatcttacattccaggtgaatgaaaacggaatagaacgaagtatcgtagaaaatatcagttttaacgtagaagacggggaaatgctggtgatcaccggtccgaacggaggtggcaaatccacacttgcaaaagtgctgatggggattgaccaggcaagtgccggacagatcatcttagacggaaccgatatcagtgattatgatatcaaccacagggcagaagccggaatcggttacgcattccagcagccaccacgcttcaaaggaatgacggtaagcaagcttttatcacttgcggctggagaagatctgacaagagatgtctgttgcagacttttaagtaccgttggactttgtgccaacgaatacattgaacgtgaagtagacggaaccttatccggcggtgaaatgaagcggctggaaattgcaaccgttctcgcaaagccgcacaaactctgtattttcgatgaaccggaggccggaatcgatctctggagtttttctatgttgatcgaacagtttgaaaaaatgcacaaagagaaaaagcagagtcttattcttatttcccatcaggaaagaatcatccaaatggctgaccggatcatggtaatcgaaggcggaaagattgcttcgatcggacagaccgcggatatccttccacaattattagggaagacagcagattcttacagctgtctgaaatgtagataacaggggaggaagatacaatgactttattggataaaattacagaaaaagtattagctcagatcgatgataccggttttacacagtccggtgcattcaatttacgacataatgggatcgcgctctgccacggtgacagtgagcatattaaaatcaagaaaaaacaggacaagccgggaatcgatattttcatcgatggaaaaacagacggcgaagaagttcatattccggttgttgttgacgcaagcggaatgacggacgttgtttacaatgatttttatgtagcagaaggtgcaaatgtaactatcgttgccggatgtggtatccacaacagcggatgtaacgaaagccgccatgatggtattcatactttccatgtggaaaaaaatgcaaatgtacgctatgtagaaaagcattacggagagggtgaaggcaccggagcccgtgtactcaatcccgttaccgaagtttatcttggtgaaaattctgtatttacgctggatactgctcagatcaaaggagtcgattctacggttcgtgaaaataatgtacatctggaagccggttccaagctttatgtcattgaaaaactgatgacacatggaaaacaggaagctacttcaaatatgatggtggaactgctcggagaaggcagctctgcgcagatcgtatcccgttcggtcgcaaaaggcgaatccagacaggtcttccatccgagggctgtcggaaagaaccgttgccatgcacatgttcagtgtgattctattatcatggatcatgcagaagtaagttcaattcctgagatcaatgcgaagcatgtggatgcggctattatccatgaagctgcgatcggaaggatcaatgatgagcagttgatcaagctgcggactcttggaatgacggaagaggaagcagaaggggtgattattgagaacttcttgaattagagtcatacgtgtagtagtaaaagagacaaaaaagacaaaaattatcctctggctatgctcagttgcactaaccattccaccgagcctttgaaagcatcaattgtgtcagcaatggcttccacaattgattaagtctcggttccatagtgcaaaattcgcagatccagaggataatttttgtctttttctgtgtcttaactccactacattataaaatcttatttaagtttcaagaatttctcaatgcaggattcacctggacaggcggagcctgtctcgcttgggtgttgaaatctctactgttcaagtatctttttacagattttttcaaggatgtcttcaaggtctgtgttttcgtagcgttctgtgattccggcgtgggcgaggttttcttcggagaaatctttggaatcggcgagaaaacggcggcacatttcggcgtattttggttctttctgggttttctcacgggcgagggcgcgggttaagcgctctccgtcttctacctcgatgtaaagtggaactactttttcgtttccaaaataggttttcaatttttcataggattcaagggttccgatcatgagataatcctgatttttttgttcaaaattgaactgtccgtcatcagcggtgaaatagtgccagataccataaactgtattgtaagcacgttcttcgatcaatcgactttctgttttgaacttttcaagttcagtttcgtctgtaaagaaatattcttcgccttctttttctccctcacgccgtggacgggttgtatagattgttacattttttaactgtggaattctttttctcagttctttgtagattgtgtctttccccgttgaactttttcccatcagataatatattttactcatgtttccacacctttatcttgccttccgtctgtattccttctatttggagattctgtgtttcataataacaaagaagttctactgcttcccggctgatccgctctccgggtacgataaccgggcttcccggtgggtagagatatgcgtattccagagaaatgtgtccttcactttctttccacggaatctcttctgcttctccgtcttcttcccgttctgctgcctcctgcggtgtaaaatactgctccagtctaggaagctctccggaaatctctatgcttccggaaacggctgtttttgcttccagctgatcatctatttccagtaatgcagcttttaacctgttcagtccttcctgcgtatctgccacggtcgtcatcgcaagtacataggttcctccggtcatttccatttccagatgatattcttttcgcagccggtccgcaagctccggacttgtaatatttgcatttgctgtggaaatcacaactttggaaatatcataatgttctgtacggagaatctgtaaatgctgtaatggcttcagctcttctctgaacttttgcagcctctctacataaagttcaaatgcttcctcacattttccatccaggaaatccacgcaggcatccaggcttgccatgaaaatatacgacggactgctgctctgcaacatatccagatatttcttaattcttcttcgattggcaagctttccgttgatatgcaggattgcagtctgtgtaagagaaggcagtgtcttgtgcagactgttgatcaccacatctgctcccagatcatttgcgcgccccggaaatgccggatgaaatccaaaatgcggtccatgtgcttcatctacgatcagtggaatcctatacgaatgtgccacttccgcaattcctttcacatccgataccacgccatcataatttggagatacgatcacaacggctttgatatccggctctgcagcaagtgcttttgccacatcttctttgctgatctccccgttcatatgcatggaaatatcaaattccggatacacatagcgcggtacaagaccattcatatagattgcatggtaaatggatttgtgacaatggcgtgccaccagaatcttatctccccggtgcgtacatcccatcactgcacttaaaattccggcagtacttccatttaccagaaaatgactttcctctgccccaaatacccttgcggctctttcctgctcttcttttaaaataccatctgcgtgatgcagatcatcgaaaccatcgatttccgtgatatccagatcgtatggaagttcaattccaagaagtgccttgtttctcttatgtcccggcatgtgaaatgcgtaaaaatcgctctcggaatatgcttttaatttatcgtatagtcgttccattttaaacctctttaagtcttttagaaacatcatataatttttcttccgaaaacgcaagaggacgaaacggttctcccatttcgtccttcccatatattccggcttacacagctacaatctcaaacacttccgcctggaaatctcccttatcattcacgcccttcttccatacaccggacgcagaatcggacaggatcattccgacttgcatcagctcatcgccatagcagtcataagcatatccgctgaccttataacaggtatcttctttcagccctttcagcttcagtctcttaaatccaacattgaccggctgcattacccggtaataaccaaccagcgccttcttctgatcctccgatacgatcatccatgcggtctcatttccctcaaacggactcttcagtcgatagaaagttcctttctggatcagatctctcttctccttcataaatgcgatctgacggcggatttctgccttatcttcctcgccaagctttaaaaggtcaagctcatatccaaaagttccaaagtaagccacatctgctcttgtctcgagcggtgtcacacggtttgtctgatggttcggtgaagctgatacatggcttcccatacaactcaccggataaaccattgaagttccatactggattttcagacgttcgattgcgtcagtatcatccgaagtccatccctgcggtgcgtagtaaagcattcccggatcaaatcttgccccaccacttgcacaggattcaaacaatacatgcggaaaacggctggtcaggcgctcatacagttcatacacaccaaggatatatttgtggcagacctttccctgatactctctgtcatttccattggagaacacctctgaaaatgtacggttcatatcccatttgatataagataccggcacttctgcaagaagattttccagcatgtccccgatatattcacgtacctctttcttagaaaaatccagtacatactgtgtccggctgtggcagatccgcttgccctgttctgcaagaagccagtccggatgcgccctgtacagatcactgtctttgttcgtcatctccggttcaatccagagcccgaattttaaatctttggcattgatcttttctgccagctcctttaacgttcctttcagcttttcctcattcggataccagtcgccaagggaagaagtactgtcatctctctttccaaaccatccgtcatccaatacaaaaagctccattccaagatctgctgccgcatccgcaagtcccagaagctttggcgcatcaaaatcaaaataaaatgcttcccagctgttgatcagaatcggacgaaccttatctctccatgttccccttgccaaacgtgtgcggtacagcttgtgaaaggtttggctcattccgttaagtccggcttccgaatataccattaccatctccggtgtctggaaggattcgccttttccaagtgtccacttaaatccatttggatggattcccatcagcacacgggcggtatcataattgtctacctctgtctgtgcaaggaaatttccgctgtaaaccaggctgaaaccgtagacctgcccctggaactcgtctgcattttcacgcgcaagtgcaaggaacggattgaactggtagctgctgcatccgcgcatactgtaaatactctggataccgtaatccagcttatgtcttctcacatagcgctctctcgcccacacaccggcaagatcgatcatctcataatccttgtccggcagatccacacaggcgctcattgcagaaagaagtgtgatcttttcgtcagaatcacattcaaaacgtacacttctcgcgatcaccggaaatgcttcatagatcgtatataaaaggacaattcttgtattgatacttgtatcctccagaaccagttccagagtctgcgcctcatcatcactttctacataagtcgccggaagtccttcaagctttggtttgccattataaattttatgctctttatatacaaactcgactacatggcttccattctcccgctcgatctcatatgccggaaaacgcatatctccgcagccgaaagtcggatactcctgcttgatattctccagtgagaatgtagaatttccctcgaaagcatacggtgacatatcacgcatcgcatattcaaaaagatggctgaaatcttctctgtgtgtcaggcgttttccatagtagagctgtcccggctggtcgttgtcaaggatcttgatgatatagctgatctcctggttgtagagatgaaactctcttgttttttcattgtatatgattggcatatcgtttctcctcattccgtattgtataacgttcatttttccgtattatctgtatagtatcactgttggtttttcagcgtcaatgattcctgcggataaatttgtaaaaacgtacactcaaaaaagggactctgtcctttcctgaaagacatcatcccttttcctttcttagcagatttatttaattttctctttgtattcttttactctgcactactgtccactttccatccaagcgccttctctaccgtatcgatcagtacccggcttactctttgtgaaccgtccatctgtacataatagtaggtcgcactgtcgtccttgcttcccacatagaatgtaactgtcttttccttgtcatcatccgacgtatccttgtaagtcagctccaccttcgtccgctgatcttccgcaagcccgtaattgccaagcgtcgcgtccgtcacatgataatctgcacaatctgtaaaatagaatccggaaagtgctgtcataatacttgtgacagtatcttcctgatcctcattgtccgcttcgtaggtttttacctcgtcacccggttttgtcacagtctcttttacaaagttatcggatgtaactgttacaaagctgtccttttcagcaacatctgcaagctgccataccatttccgaaatcagatctgccgataccgtgtacactttttctgttccatcttccatgaaataataattttctccggaagcattcccgattagaaatttatgtgcctcgccatcctttccggtcagcgtaagattatattccggcgaatcaaatccatagtccgaaaggtcatccggattcttgatctcttttaccgcctgaatatccgaaaatgcatcttccatattttgcatactgctctccgtcagtgcgatcgtggtgtccggcgcatactcccaggtatcatcctcttttacaaaggacatttcttccccagatgcttctttatactcgatcgactccagcgaatctgtctcaaaaatatgcaccactgcattttcttttttcttctcttctgcctctgacttagatgtattccattttttcagtccgaaaaatgtaatgagcagaacaagcagtacgagcagaaggattcctattgtccttgtttttttctccatcttttttcctcctgcctcttacgctttccgtcttctcatccagatcacaaatccaaggatcagaattgcaagcggaataataaagatcacaaggatgctgaatgcacctgcatgcatcggtgtgttggtctcagtcgaaagactcttcgcttcaatcgcaacattgtttacattatcaaaattctctgtcactgaatttacaaacaaagtcaggttatccagtgtcgtcagctgatctgtgatatccgagctgatcatagatgcagaagcaagcaccgtaagtcttgctgtctttgtgtctgtatccgttgcatcactctcatcgtcttcatcctcgctgtccgaatctgaagaatccgcagaaatcgcattggtagaaacggctcccaggatatactgtccctgtgtctggtcattttctgtcactgcatatccactgtctgatgtctgcataaatgaagtaaccgtcagattatcattatccgtatctgttttctccataccaagtgaattcagcagaagtaccatttgattgctgatgccgcttcccaggtcaccactcagagaaagctgtgggaagattgcataataatttccctggtagcatctctgggtatctgcaatataaccgctgacttttttcaatccataatccgacataattccgtccagatttggtgtgtctgaagtcgtatctccaaggatcagataaacctttccgccgtcactcagatatttctcaataattgtcttttcatcatctgtaatatccgatgtcggtgcatagaggaacaacaggtcacagtcatccgggatttccggattcatgctcaggttgatttcttccgtctccagattattcttagtaagcagatcacttaccgaacttgaaaatgtcgcttctccgtgaccactggttcgataaatcttgcttgtttcctcgctggttacataattgatcgcactggtaagctgtccttctccgtcgaaagaactttcactggcacttccggtcgtataataagagtaataatcggactggataatatctgaaaatgaaatagttgtatactttccggttgcatcacaggacacaacgattacattcccatcggtattatatttctgaagaatggacggatgcagtacgctgtccacccattccacttttactttgccggaaagcgccgcatattttttcacaaaagtcttgattctggtatccacagaatcctgttctgcgattactttcaaatctacttttttatccagcttcttcagcatttttgtggacacgctgctgatatcgtacagattgttgctgctgatatcaatatttcttactttttccggaagctgtcctgccaccagattgatcacgatcgcgattgcaatcacgatcactgcaagccctacgctgtaagttccgttccgggaagacttgctgctgaacatttttttgattttttccatgtcttctccctcctaactccaacgtcttttctgaatggactgcatggtcaggaagataaatacacctgctacactcagatacaggatcagcccactcacatcgaaaagcttgttatatgctacgttgtcaaatacatctgcaagatacagcttcttcataatgttgaccaaaatattttcaaataatgaagattttacaaagcttacgatcacaaccgcaacaactccgatcgcttcgataattcctgcgatcatccagtttcccgtcatccggtaaatgatcagcgccgcaatggtaacgaataccacaataccgatcatgccgcttgtagctgatgtcgggaggaaattgatcagtcctccccagagatagatcagaagcaaaatgccaaaggttgttactgccgcaatgatctgactttctgtgagtgacgaaagaaacattccgattgccagatacacgcatccgagcaggaagaacatcaggatcgacagataatccaccttcagatacgccgttccaaagctcttaatgataattgggaaaatgcaaaaaatcaggcacggtaccgcaaataccgtcaccatcgcaaggtatttccccatcacgatatcaaataattttaccggtgcggcaagcagaagctggtctgtcttgttcttccgttcctccgcaaaggaacgcatggtgagcatcgggataatgatgatcaacacgtagttgatattcatcagaacatatgaaaaatagggatatcccgaatttaagttgtacgccataaaatagattcccgtgaagatcacaaggaaggcgatcaggacatagcctgtcattgattgaaaataggattttaattctcgtttataaattgctgtcattttcgagatcctccttttcatcctcacttgtcggaacggcattttcttccggctcttcatccatctcagtcagctcgttctcttctgcctcttcctgcgcatttttcttgcgccgctttaccatccgacctttcttttcgccgtccttcatcgctttttctgctgcaggtgtgcttccctgcgtcagctccaggaagacatcctccaacgtcgtgcggctgtgatacaacataagtaacggacagccctcctgtgcaaatgccataaatactgtttccctgatatcctttccatccttcgggaacagacccgcttttaccgttccttcttcttttccgtattccacagatgccttctgcacattaccgattgtgccgatgactttccgtaccgtatcttcatttccctttgccaggatttccacagtctgctgattcgtcagaaacttttccagattctccggtgtatcacttgccaccagtttccctttggaaataatcataatataatcacagacttcctggatctctgccagaatgtgcgagctcaggatcacggtatgctcttttgccagctcgcggatcagttcacggatttcaataatctgcttcggatccagtccgaccgtcggttcatccagaatgatgatctccgggaatccaaggattgcctgcgcaagtccgactctctgcttataacctttggacaggttcttgatcagccggtcctgtacatccataatcttcaccatcagcatgaccttctcaatctgctcttgccgttccggttttgggatcttcttcaattccgctacgaacctcaggtattcattcaccttcatatccgtgtaaagcggtggcatctcaggcagataaccaatacatttttttgctgcctccggttcctccagtatattgtgcccgttgatcagcacttcaccttctgttgcgccaagatagccggtcataatattcatcgttgtagactttccggcaccgttcggtcctaaaaatccataaatctgcccggtatctacagtaaaattcaaatgatctacagccagatgtgagccgtatttcttaacaagattttttacctcaatcaatgttgttcctcctgactacaaaatttcatgcttttcaattatacggatgatttgtgaaacttctgggggcaatctgtgttcattctgtgttttttctgtaaaactgtgaactgcaaaagtgtaccacctgcccgataataatagaaataccgatatctggaatcagctttcccacatatcggtattttatatttttaaatcacttttttacccgaaaaagacttttttatatactgggcagatttcacttaactcgcgattatccacaccagtcaggcaaggaattcttccagaatttcccggattcttgcctcttttgtcggctccagcttttcgccggtatcttcctgcttaaatctggaaccggctgtatcttccatccgtgctcccggctgctgcgtccgcatttcatcagcctgatttgcattcgcctgtcccacttttgctactgtctgctcggtctgctgcatttgtccatcttctgtataccgtttttcgttcgcagaaaccgtatttaccgtggctacgcttgctggcacggtttcttctgaaaatggtctttgcacctgaccagaatgcgccgcttcattttcctctgcatccattttctccggaatctcatccgctctctgaaccgtaacctggatttctttctgattggtcttctcatagcgatgagcatatgtattttccagaaaatctaccatataggttttcgctgcctccagctgataggcatcatccgcaagcatccggagtagaaagagcgccaaagctcccataccgcccaaaataccatatctgtaaagtccctgttccctctcccccgctgcataagcaagcgctgttcctgtggctccaaagataaggcagagccagatgctccccttcgcccactgcctccaggtatgtagcctcacgccaagcacccggtattcatacaaatatttctctacaaatgcaccaacattctgtactttatcactcaccatacacccatgctcaaattttgcccttacaagccgcatcagcggatgattgcttttactcatgttacttgctgctcttaccagctttttcagtgaaatcccggtaatcagtcttgcaatcgcgccgatcccgatcatcactcccgtcagaaaaaataccgtttctctcaccacgaacatttccaacataaaaagaatcctccttcttagatttaccgtcattataccgtaaacctccgaatttggattccctaatcgttcgtcacaatccgacatcctgtctggaaaatgacgctgcttttctgttttactttgctgccttacgcattacattctttctacaagacctttgacaagccctacataatgggtgattgccatcttcacaaactccggataatccatcgttgcactgttgtcagctttgtccgaaattgcacgaataatgacatacgaaactttattcagatatgcggtctgcgccattgctgcgccttccatctccgcacactttccatcaaatgtctttaccagatattccttcttttccttgccggaaataaactgatctccgctgagcactcttccggtaaatgtctgaatgtccggattcacttctttgtttacttccactgccagcttcacaagcttctcatctgccggaaaagaaaaggtatccattctcggaatctgtcctaccggatcgccaagcatacttacatccatgtcgtgctgaactgcatctgtagaaatcacgatatccccgatgttgatatctgcatccagagaacctgccacacctgtattgatcagcgtatccacaccaaaacagtcaatcagaatctgtgcgcagattcccatgttgacttttccgataccacttcttacaactacaacttccttgccgctcataatacctttgacaaaagtcattccggcacgttccatcgtatcctgaacttccatcgattcctttaagattgcaacctcttcatccattgctccgataattcctatcatttgaaaatcctccgtttttcctacatattgtttttatctatatctatagatttcccttcaaaattacaatagctattatatcagatttcttataatatgcactagcattttcttataaggctgtgttataatcattgaagcaattttataaggcacaataatagtataaatataaaggaggactatactcatggaatttacaccacacggcgtctgttctaagaatattcacttagaagtagatgaagctggacgtattcataatgttgagttcacaggcggatgtaacggtaacttacagggcatcggacgcctcgttgaaggaatggatattcacgaagcaatttcacgtatcgaaggtatcaaatgcggatacaaagcaacatcctgcccggatcagctttcacttgctttaaaagaatatttaagcaataaccagtaatcaaataattttttcgcaattttgcgtcaaaacaagcaggtcaggaattatcccgacctgcttgttttggtctaattcagtttaacattagttaggcttcttgcttgctctgatgttccatactcacatacttcgcgaccgagttgtattatttggtcatatgctttctgtccaatcagaaaatacgtttattagttgtggtctttacagttctgttcgccctcatgtcagtctgcaagaccggagatgttgaactttatcaacctgcaattcagacaggtgttaaaaggaatcttcccatctccctccctcatattgttcccttgtccttactttcgctaactgccgcaccggttgatagtcgtatgaatattttataaaaaatatttttggtttggtggtgcggggtgggttagagtgggtaaggggttgggatgtttggtttgtgatttttagatgtaaatgccgtctgtgtacgaatcacttacgtctgagtttgcataatgcacacagtacactcgataataatatcctgtcggcacagataaagttttacttgtacttacataaacagaattgtagtttgtttcaacccatgaagtatagtatccccattttccgttcacatatctttctactgttacatccactgtaatcttagaaacaactttctgccctactgtgtttccaccagcaccgatttttccagtacctgctcttacaatattagatgatccacttttcagatatatgcctcggcttttggaacctactgtcacttcagatgaatcatcatttgttaaataagatccatcaacacattccggtatatctgtcgcctgtacatttttctgtgtaccgataagcaatgcacaaaccattaccattgccataatcagcgataaaattttgttttttttcacttttcgcctcctctctacactatattaacaatcgagagaagaaaatctcacgccatttctagaaaaaatataaattttttaaaagttctttaaaatcatcttcctccatcgtcgcatttattgtataaaatacatcttcgtatgtaaactgtgctatattctcttcattgccatcatctagctcatactgaataatatctatcttatttccatcaaccgttgtttgtgttctttttacctttttgtcctcaatatcatacgcatatgatttattctcactttgaatttccatttgatattgaataaacgtattattattttcataaattaaacaaactttttttaaaacctcgtcaatatcactctgtaccaatgccattccatctgaatttctttttaatctaacaacatcaacgccaaacttttgttttatttcttcatatacttttgcttcatcatgatcatccgttttatttttatctccatcctccctttccgtattaaccttaaccatttctctatcaccaataatatcattcaacaccctgccaaagaacggcgtcccaccaatactcaccatactccacatcatagcaagcacagccacgatcgccacgattccatataccttccagtgccgttttctcttcttaactttcttcttcccggctttcttctcgatctctccgttcgtaccgtcgtcacttgctttattatctgtttcatgcttcacatactcaattggcacaacattatctatataactgtcactctccacatctttcttaagatgatctttcgtattctccccgccgcgaagtgcctgaacctctcgtccgagacggattgcctccttgtcgtcatctgacagtttttcatatgctttctgctgttcttcatattcttggattttactccacatcttttcatccaggtcttctggaaaggaaatgtcctgcagtgattcgtccgagtccatttcttccatgatttccccggcttctttttccagttcagcttttaaaagcttatccagattatcttcatgtttttccattttaaacctcattcttttggatttcttttccctttaacttgacctttttccttcacctgtttaatattatgatatcagggcagtctctctgcctgtatcaactgcgaatcttaattcgcaccatcaatgggaggatttttattatgaaacgcatcattctgaccggcggaggtactgccggacatgttacacctaatattgcactgcttccccgtcttcgggaactgcagtatgacatacattacatcggttcttacaacggtatggaaaagcagctggttgaacagcagggaattccatatcatggtatctcttccggtaagctccgccggtatttcagccttcagaactttacggatccgttccgcgtcctgaaaggcttcagtgaagccaaccgcctgatcaagcagttaaaaccggatgtaattttttcaaaaggtggatttgtaagtgttcctgttgttattgccggaaagaagaaccatgttcctgttatcattcacgaatcggatatgactccgggactggctaataagctttccattccttcagctgcaaaagtatgctgtaacttcccggaaactttaagttcccttcctcaagataaagctgtccttaccggatcccctatccgtcaggagcttttcaccggagataaagaaaaagcccacgctttctgtggtttcaaggaagtaaaaccagttatcctgatcgtcggaggaagtcttggcgcagtcgcagtcaataatgcagtacgcaagattcttcctgaactgttaaaagatttccaggttgttcatctctgtggtaaaggcaagctcgatgaaaagctcaccggtctggacggctatgttcagtttgaatatattcaggatgaactgaaagatctcttcgcccttgccgatgttgtaatctcaagagcaggtgcaaatgcaatctgcgaattgcttgctcttcgcaaaccaaatcttctgattccactttcagctaatgcaagccgtggtgaccagattctgaatgcccgttcttttgaacgtcagggattcagtatggttatggaagaagaagagcttacagatgaaaagcttctcgcagctgtccacaagctttatgattcccgtgaagacttcataaatgcaatgaatcagtcttctcagcaagatccgatcaagacaattatcggtctgatcgaagatgctgcttccaaataattttttaacaacagttatttacattgttcaaaaacaggtgccggaacgacacctgttttctttacatatccatcggtgctattttgtgtaatcatcagaattgtaatgtatctttacccattttcttgctctgtacagtacacccgtcagtgcttggatactgatccccatagattcagccacatctttttgttttctctccagacagtaaaccatggtaattgcttcgtaccagttttcattttcttcgtacaatgcatccagaatcgtccatccataacccactttttctttttgtaaaattttgtggaatacatgctcctctgcactttccgcatattccttcgagtacagatccgaaaacagctcaatatctgccttcggacattctcttgcccgcttcttcatataattgatagctgtatttttcgttgttgttaccagccatgctgccatgtattcttcatccactgtatcaaagtgtgtatatagttttagaaaaacctcctggaatatctcttccgctgactctttgtgactgccagaataatccattgctatccgataaacgttgaacttatttttatagtacacgttctcgaattcctttttattcttattctgaaaactcactctagtacctcactattttatttttctttcagtttttccaggatttcatcccgatcttcatctgtaagtttacccggtttccagccgaatccgctcttgtcatttttatatctcggaatcagatgcatatggaaatggaatacggtctgaccggccacttccccgttattctgtacgatattatatccgtcacatccaagtacatcttttaatcttgttgtgatcttctttgcaagcttaaatgcttttcctgccagttcttcatcaatagaataaatatctgccgcatgttcttttggcaggatcagtgcatgtccctttgtcgccggtccaagatccagaattactctgaaatcatcatcctcatatatggttgcagatggaatttctccatttgcgattttacaaaaaatacagttctcatccctcatgttttttccttctttctacattttcttcgattaatctcgaatttgtttacgaaccagactttcaatgataaactacaactactttatatcatggaaaggatggtcgttaccatgccatttactgcaaatgattatgaaaagttacatcagcttatgaattccagtccggaaattcgtgaattacttcagaaactcctggattcacagcaatatacaatcagcaagatcagtcatgaagttcgcaatccactgacgctgatctacagtacctttcagctcatagagtccagtcaccctgaaaccagagatttcagccactggtcagagcttcgcgaagacatcgaatacacaatctctctgctgcaggagctgtctgcctataataacagtgaacatctgcatctgagcacgttttctgcacaggactttttgggacaaatctgcctgtcctttgccgcctcctgcgtagataccgacattggattctcttctctgatagcccctgatcttccatctctgacggccgacagattaaagctgcatgaagcgattctcaaccttttaagaaacgcccgtgaagccatttcgtctgccggttcaatccgtctggaagcagtcctcaaaaatcaaatgcttcagattaccatatctgataccggatgtggaatctcaccggaatatctcgacacgatttttgatccttttgtcacttacaaaccagacggcaccggtcttggtcttgccattgtcaaccggacaatcacagctcacgccggaacagtaacagttacttcctcctgtggaaaaggcacttcttttttgcttttgttaccaattacataatcatttttattataaaaaacacgtaattgttttacaagtacttctttccataaactgaaaaatgtagtaaaaagaaaaacatgtcctatcttacttattcctctgaatcatccgccattatctcatcccattgggattcccgtttttttctacgtttctgaaggcgctgattcagaaatccccagacgctctgcctgtcctttacaacctgccctttcatttcctgttctgcaatccagtcatccagaatcagttcctcctgcagatcatatcctacttttttctccggctgtatactctccatttcattctcctttttctccagtatccgctccagcgcatactcaatattataattttcttccattgaagccttatgtaattcatatgccagatagactgcctctttctgttcataatctgtctccctgacaaaatactctgtaagctcatgaaacttttccagaatattaccttccagtcccggacaataacaaaagtaatagatttcatccgatacataaatatgtcccggatccaggctcagacagttcacgttcagcagataattcttcactgcataaagcacctggataaactgtctcataaaattttccagatctgcaaatttccagtgctctttttctccctttgccttcacggatatcttcccactgatctcgtagcggtactggcttttatcatcttttccctgccctcttaccgacaagagtccgggaatcgcattttccatcagcatccgcatctgataatcttctttatatagctcatctgtttccagaatcatccaggcatgatgtaaatctctttcgtactcttctctcattcctcctggtccctttctacaatctcctgcaatacttttttcctgcgtattttttcctccggcacggtcagtgccgcactgcgtttaacagatacgcgcatttttctcttttgcgctcctgctgtcacttcaaattcatcttttactaccgcagtttccaccgatactgcatcaaaaaatatcagtttgttttcaattcttttctgaaaatactgctccatttttccatcttctatttccttttgccatcgccattcttcacttccgacaatcgcagtctcatatgccgccccaccgataatatttttatcatggtaataaaaaagtgcgaaaatgactgccatccaacaaagcaatactaccggcatcagatacgccatctcaactactgtacttccttttagctttaccatataaatgtccccagatagccgatcagaagaaaaggataaaacgacattcttgtcgtccgtttccattttccgctccaaaggcctgctcctgctgccatcgcagccacaagaaatgcaagcatcagcattccaagcagattccagatccctagaaaaatacccatattcaggatcatccagctgtctccgtaccctattccctcctgtgaccatttcgatatcatgagaaatacaattccacatcccagtccggcaacccatacactccaatgcatccgtccaaataatgcacggtacagaatcgccgcacagcttcctgcgagcagatattctgtcgagattttctgatattttatatcctgtgctgctccgaatcctaaaaaaaataatcctgccaattttgctattttccaccacattttgaacatgctccttttccttttacttctgacagcggaactgtataaacttttctcttcagtccgctgcatgataatgaagtatgataacgatccccgtaatctgtgacatagcagttgtcatcatttcccggcatccatccacaccgttcacacaaatgataaattcctccactgctgtttctcagttccactaactgtgttttcgcaacactgcgcacggacggttccagataagtgcactgataattccgatgatatacgatccctgtttctgtcacatatacaagttcattatctccaattcctgcttcgtaggtctttacataaccggtccatgtcttcatcctcattttttctttataatgcagtaccggaatatgaaagacaggaaccggcaattctacttcatattctgccgtcagttccagcactcccattcccggtatcgcccaggatcttttacagctgactcctccgcttccgccaacaatcatacttcgatccattctttctttcccgaccgcatttacaagatctgcatgcagacttatcgggttcagcaccggaatttctgcaaaactctctgccacctgctttcctgcactctgcagtccgcatcttactgcagactggatgcttctgagctccagcatccagatcaggctcaccgccgcatataggaacagcggaacacaaagtacagcttctactgttaccgaggcagatacagatgccttttctttgacacaagatatggcgatcaaatcaggtagaaaatcaaatccttcctcctttctgcaaatatcaaatatgtgtttgtaattcaatatttttctatacatcatcaaaggaattttatttattatttcgattgtcctcagaaaagacacctgtatccacctcctaacattttcattttttgttattgatattgatataaaatatgatactgataccggattcctcttctcagataacatgtcatgtcaaagtctgctcctgatacgcaggcatctgcccggaaaaacgttttctccattccggatcgcagattcatttccaccagatccaatgctctcatcgacagttcttcctttgattttaaaaccagcatcatttgcagatactgctcataagaatttccctcttctgtctcctttccttccggaatacttctgttctttgccagctcaagcagaccatccagcgtcagattccagctttccttactctttacagccggaaccttcttccctgccagaagcgtcttaacatccgtaaggctttctccataagcccatgcaagaagcagcgcatgcttgatcacaggtccgatctccggtgaaagaaacaccgcactcagtgtcgttgcaagggtatccacctccatttgcatgtccttatcggtcagcaaatatccataattcactgcaaatcgaaggattcggattctcccgatcacatattccagattgtccttgtcgctcgcctttcctcctaacaaatactccatctcatagtccagtaccgtattctttttcttatttgcagcattgccaaacttatctataagatacagattgaaaaaaatggtatctccggctccattatctttttccttcatggttccgtatccctgcctgagctttcggttcgatacagtctcttctgactttacagctttcgatgacagcgtaaatccttccgggctgaccagatttaacagtgcttgcgcctgtatatccacaatatccgccaatggattattttctgcaggaagttcttctttttcactttccagcatctggtcaagttctttactcgtctctatattctctttcccatattcatttgctttcagttcctgctccttccattcggatacctttcccgtcagattctctatcgccgcagctcctgtcttcattttctcgtattcaaccgcctgccgcagaaattctttcccattctggtctgtcagataacggattgccgcaatctctgtttctatattttctgccccgtaaaaggacagtcggtttaaaatattttcttcagacattgttccggattcataactgccttctattgcaaaaataccatatcgctccagaagatccttctgatattctgcaaacgcagattccactgccctgcctgcgtctgctcttttctcattctttgccagctggatcgaagcgctttccagcaaagccccaaccagagtaagaagcagaagaaagaccaggcttagaaacacagtaatctctccctttaccatttttttcatttctgtacacactcatttctgaaataaaatttttattttagattcctgaactttcattcgttattttttcaaatattttagttacaagttcattaagctgtttcttaaaaatgataaccagaccgataatgacgaccagtacaaggatcaattctaccgttgatatcccgtctttttccgtcagaatcttctgaattctgatccatcctgtccacagcttcttttttaccgccttcattctctcacctcctacacctggatcgacaaaaatgccggtacaactacgatcgtaatcacgatgatcagcatcaaaagcattgggatcaaaagtctggttcctgcctcttctcccagctgtctcgccctgctctttctgtcctccagtgcctgtactgcctccatacgaagcatttcagaaattccttttgcaccctttttcagattctgtgaaagaagtgctcccattttcatatacggaatcagatcacatcttcttgcaaatctttcataacattccatctccggaatcccacttttcatttcctgccaggttttccagatttcttcatatgcttctctttttcttcccgtttttcccctggtgatcccatagtcttctgcaatccttttccacacattttttgctgtcattccggcaccggtcagcatcgtaaactctgtgataatttccggataatccagcatcatctgctcttttctcgtcttcttccgattgctttctttctgtatttctcttccgacaagcagaatacttatcgccattccgagcatcagaatcggaatcacttttgaatctttctcctctgtccaggcaatttttcttccgtccagactgggtggcagtgtaagatatgctttctgcctcgtagcactgtcctgtaatcttaccagttccagaacacgctctttcgtggaaagcgttttctcctgtcctgcaaaaataacaagatccatctcacacggatataccttatcttcataatgcagaactccggtaatattcatcccaatcccctgattctccggatcttcttcccggattttttcctgatccagtcttccaagcgaatccattacatcatatctgctaagttcccaggaaaccgaaaacggaaaatcgtctaatgctgttaccagatccagatctgtctttatatgcgacagatccttattttccccggaaatcacttttgcaagctctttcctcgctttctgaaactccttttccagccgcttttcactgtaaatcttcggtgacacacgaatttctatatcctgctttttttctccttcaacctgcatagaaagcgccgcttctttttgtccttccccgtacccgttccgctttatctgcatggtttcagagttttccgtccctgtcttctgcacgatttccgacaaaaatgccagacttgtcaccgccaacatcaaaaaaaatatctgcctgagaagcctgtcccattttctgaaaagtgatttcttcttgaaatacgtccatgcacaagctccgagaaagaaatacattccgatacaaaaccacatttctatacctcgatttccacaatcttgcatccaagtctccaggcagcaatgtaagctccaagacaaatactcataaaagccgctcctggcagattcccgtataaccccgccataaattccggaaagctcagacgcatataaccaataattcccaaagggatcactgacatgatctgaaattccatttttttcgctgcaattacggtatcgatttctctttttacttccgctttatcaccaagttgtctaaccgcatttttaatgatcagaatactgtcgcctccgctcctctttgccagggaaaatacagtgacaaatgtatccacctccggaagtgctacccttgcagcaaaatccttccaggtagcttccgcggttacgttcagattcagctgccttaccatatacgtaaattcccgtacaataagtgtatgcctgtcatatatgatctgcaggtctctctgtacctctttgatcgcgttctccatagagtatcccacattcagctgcgcttccagtgattgaagcgcatcctggaactgtctttcaaaacgtctcttccctttttcctccgcctgacggatcatcctttcgtaatacttcattcccataggaaaaagcactgccatcatccacagtcttgaatagaacagcatggcgatcaggaacaccagaagaatactttccgttattgccagggcatactccttccggctgataccctgccgccataagtttttccgtccgtgtaagtgtggaccttttcacccactccccctggatttttccatccttacttcccgtctcctgaaaggaaaataacggttgaagcctgatttctcctttttcatatcccaatacctccatgatttccaatactttcctgctcttgtcccgaaggcgtcccagatgtaccaggatatcgattccggaagcgatctgacgcataactgcttccagcggaagtttaatccccatcagtaccattgtagacagtctgctcatcatatcatccggactgttcgcatgaccggtactgatcgacccgtcatggcctgtattaaatgcctgtaacatatccagtgcttcttctcctctgacttcaccgacaataatcctctccggtcgcatccggagcgctgtcctgatcagatctcggatattgatctcccctgttccttctacatttgcattccgtgcttcaagccgcaccagattgggaatccctgtgatctgtagttccgcgctgtcctcaatggtaataatacgttcttctttcggaataaaatccgacaatacattcagaaaggttgtctttcctgatcctgtccctccgctgataaaaatgttatactttgccttcacggcctggatcagcattgttgccgcttcttttccgatagagcctgtatcgatcatcgtctccatcgtaatcctgcttttcggaaactttctgatcgtaacaatcggtccattgagcgcaaccggcggcagcaccacatttactctggagccatcctccagtctcgcatctacgatcggtgttgcctcattgacaaccctgttacagcctgctaccatctgctgaaccacatcttcaagctttccctttgaaagaaactttttatcggtttcataaatccttccgttacgctcgatgaaaatcggctgcgttccattgatcataatttccgtaatctcttcatcctcgatcagctcctgcaagatatccagcttcctgaacgcgttaaaaagctctctcccgagaattgccttttctccaagcggaatgaactcttctttcgatttttcttccagtatcctgtggatcagttccagcagctcttcatcgcttgcttccttcgacagatccatctgcgccagaatttcttcatgaagttgttctgccctccgcatagaagaacctcttttctgtactttcttttaataactcaactgtttcttttactgtctgacgcatatttttccccatattgatatacatggtacgcgactccagctcctgataccgcagtaccttcaacatatactggtactgcgcaatttttgccatcgcatatacatcctccgcacacggcatgagaatctggtcacacagccttaacagctgaaatacatcctccatcccatttccgatatccagaatgatcacgctgtatacactttggctgatcagtctttcaaatagagttttccattcctctgtatgcacagcacgaagatctgtccatactttcattggcgggatatagtccagatcacccattctttttaccatggatgcaatccgtatcccgatatcatctctttcctgttttgcatagtaaagaacatttgccagatcaggagcatcctgatcccggaaatatcctcccatgcctgcataggtttccagattcagatacagcacgtcttctgactgtgccagtgctttcccaagtttcagtgaaaacgttgtctttccaattctgtgaaccggtgaatatactccaaggattcttccatttccgttatccgcacacgatccaggaaacttctcttcctgaagtccttttaaaatcccggtcatcagtccgtcaaccggctgatatttccgaagctccgtttcctcctctcccagatccacacaatgctgtctcgtcagaataattcttttcccggtaaaaatctgctttcttttttcatatggaacatcctcactgatcaacaatacctttatcagaccaatcttcagtaactcctgtaccatttccggcgacgaacagattcgcactcctgctgtcacctcttttttcaaaagcagcgcctccgcaagtcttctgacatactcttcttctggatcacaaattaaaatttctctgtcgattctttgctctgctcctttccggcatgtccgccctttttctttcaaactttgaatcaaatgccgaatggcatatgacggaacacgtttgcattccttttttgacacagtatttatcagaatataaatactgctgaaactgattttttgattttctaacttattgctttgcctctcttgtaagacgtattatatgcgccacttttccctttgtccatagctttaaaccagaaaaaaacgttttgcgcaacacctacataaactgataaaatataatcccataaagcatggcaactcccggaattccgagacatccggacacaaaaaatgacaggacatttaatccgacagaaacaggaatgtttctatagtccatccattgattgaccagaaaaatactgcccattcctgtcaaagccctgacaataaagtttatctgccatgatcctcttcttttcatgctccgccacctcctgctctatcttatgaactttttcacacagatatgttttttacctctgaaaagaatttcctatgaaaaaaagagcgccactgtctgcacttcgcagtccaatggcacttccacatatcttttataattcaatttccacttttcgcccggtccggtgatactgatgatatcgcaccccggcacagtcaaacatcattttagatgcttttacagaagttgtatctgcatacttgtctgaatcatagattacttctttgattccactctgaatgatcgcttttgcgcattcattgcacggaaaaagcgatacataaagtttggctccttcaagacttcctccactgtaattcaagattgcattcagttcactgtgtacggtgtatacatactttgtcttcagcggatcctcaccttcccgttcccacggaaattcatcatccgaacagcctcgtggcagaccgttgtatcccattgacagaattttgttatctgcacttacgatacagcatcccacctgggtattcggatcttttgaccgtcttcccgagagaatggcaactcccataaaatattcatcccaggaaatataatcctgtctttttccactcataatcggttcctctattttgttccgaaaatacggtctccggcatctccgagccccggaacaatatatccatgttcatttaacttttcatccaatgctccaatatacacttcaacatccggatgagcttcctgaagcttctttactccttccggtgctgcaataatacacataaaacggatattttttacgcctctgttcttcagcatctggatcgctgcgatacaggatcctcccgtagcaagcatcggatctactacaaatacttctctttcttcacagtcagccggaagtttgcagtagtattctaccggttcaagagtttccggatcacggaacaaaccgatatgacctacttttgcagccggaatcatcgcaagcataccttctaccattccaagtcctgctctcaggatcggaacaacagcaagcttctttcctgcaagctcttttgctgtcatcttgcagatcggtgtctggatctcgacatcctgtaatttcagatctctggttgcctcatagcacatcagcattgcgatctcaccgatcatcattctgaaatcctttgaacctgtttcctctcttctgataatcccgattttgtgctgaatcagcggatgatccattacgtgtacatttgacatttgttttttgcctcctcgtttaacttattggcaagttttttgacatacccttggatcagctcatacatctgctcatactgttcctgtgtctgaccatatacagacggaatctctttgcttccatttacaaattcacatagtgtataaacctgtccttttcccggataatcattctgtatcttttgtttgatactgtcctgcattgccagaacaagcgtatcttccccaaattcctcttctgataatgcaacagtctcatatccttctgtctcaatatgatgtctcaccagaagttcttctgctctcggattcagtggttccgggaagagaaccacaagtcctctcgcacacacctcgtattcctggaaaagcggctgctttttcagaattgctgctgcgatcggagcacgacagttcgcgctgttgctcacaaatacaatcctgcggtaatcctgaagcttcgtgatctcagatgcctgcagtacatgatgtcctgctgctttgcccagccggttcatgatcgcagttccgatacctgcctccggaaatgcttcactgtaaatgtaatcaacttcctcttcatcaaattcacgtaggactttataaaggtttctcgcaaccgtcttttcattcacacgggaacctatgcattttactacaccggtcgtatactgatcaaccgattcattagacgcaatgatccccaccttatatccaagtcttacctgctcgtaagcaatctgcttgatcgcccgaacagcctcttcaggctctccgtcaacaatgatcatctctgccttcggcgcgtagtgacggtacttcattcccggtgctttcggtgcttttgtgctgttctctgaaatcaaagtttcatccacagccacctcaccgatcacttcacttaacatctcttttgtgatcgctcccggtctcaggatcatcggtggagtcaccgtcatatccagaatcgtagactctactccgatatctacacttcctccatccaggatcatctcgatcttgccacttaaatcctctgccacatgctgcgctgtcgtcgggctcggtcttccggatgtgttggcacttggtgctgatacatatccgcctcctgcaaggatcagctcacgggcaatctcatcatccggcatacgcacagcgaccgtttccagaccaccggttgttcccagcggaactttttcgttcttattgaaaatcatcgtaagtggccctggccagaaatgtgccgcgatctcatctacaataagtggtacagattcaacgatcgcacccagatcctccagtctcgcaatatggacgataagcgggttgtctgacgggcgtccttttgctgcataggtctttttcgctgcctcctcatcaagcgcatttgcccccagtccgtagactgtctctgtcggaaatgccaccagaccgccgttcttcaggattgaaccggcttcttccataatcacctgatctatttggtttctgtctattttttttattattgtttccatgtgtttcattatagcattatccacatggcatggcaattttaatttccatactcgttcaggtattccagacattttgcgattccttttgcaacagcttctgcaatctgctcctgatattcttctcccgacaatttttctgcctcttccggattagtcagaaagccgcattccacgatcaccgtaggcacttttgtccgcctcagaagataataggtctcatttgcttttgcccgcctgtgattttccggatcaatctcctgcaaactttcctgcaggattttcgcaacagcctctccttcccgggaatggctgtaataaaacacctgcgctccatgaatttccggatcttcatagctgttctgatggatactcactgtaaggacaggtttcatctcgttgatcatcttcactcttgcctgcatatcttctgtctttttacttccgtctcctgttgttccaagccctttatcctcttttcttgtaagctctgctgttatcttttccttttccagacattttttcactttcttagtaattgccagattgatatccttttccagaaggttattcagcccgatttttcccggatcacttcccccgtgtccggcatccaggattacctgatcctgctttgcctccacctgatccgcctcggtatacctgcttaatgtataactgccataaatacatcccgtcagtaaaataagagccagaatccactttattttgctcttgaaaatagttttccccctttttactatttcactgatttttttattcaaaaaagagcctcctgcatatatttttacaaatatatgcgtggaaagctcttttctatacctttctcattatgtaatcagtttacatatttctgaatcagatcccagatatcggaagtctcaaatccaagtttccatgctgccgttcctgccagattattgtccttcataagtccaagtttgacttcaagtgaagaagcatcctccagccagatcctgtaggttgaatcgttatctccctgccactctgcatagttctgcttcgccgtatcatcccatgtcacagttgctccggcttcgcttacccgctgtgccgcttcttccatgccaagtgcttcgctggtaactttcattgaatagctttcagcctcggttccctgatcttccgcacgctcttcgtccgtcttcggtgtctcattccacagccttgtatagaatggcactgcattgatcaccttatctgccggtacatcccgcagggtttcttcaattccctcttttacataattgtaagatgccacagaacctgcttcataggaaccggcaaaatgttcatcatatcccataatgatcacataatctgccataaccccctgttcttctctgtgataatgtgtgttataacccttcggcacataattatctacagaaaggaccagattgttcacccggcacagcacagaaagctcccggataaactgaatgtaatgatctccgacatccgtcggtatctgttcaaaatccacgttaattccgtcaattccattctgaagtgctgcatttaccagctgattctccagattctccctgcttgaagtatgactgagcagctccatatcgtctacattctggtcgaaattatcaaccagcgcccatacttccattccacactgatgtgcataatccacatagtctgtacttgcaatggaactgatatttccggaattatccgttacactgaaccatgtaggggaaatcgtattgagtccttttgtagctgcaagcgcatcttcaatcccttcgttggcagcttcacttgtgacctgatgccataccagattgatcttgtaatctttcttgattcctgtataatccggttcctcaaattctcttgagattgtctctttcttggcatccttcagctttgacttctgaatatacccgacaattccggattttgtacagacttttttccagtcacttacatcttcaagaaccgtaagcttatctccctttttcacttcttcgagcaccggactttttacacctcccagaatccttacctgggaatcatccttaacctttgccgtctgacgctctccaaacttactggtgatcacgactcttgccggatctttataaacttcgtagtcaaaatttgcatatttctgcaggaaatccagtgcaatatatgctgtatctccttctgtctttacaattgtataatcctcactgttcacagtatctgaaacagaataatccttactgtctgccgctgcctttaccatatctctcggcagtgtatacaaaagtatatgctcattggaatcccagtaaaaacgatcgctgatataatcctgtacaaagttataagacagatatgcagttccgccttctgtaattgcctgagcatccagtacctcgttgttgatcgttacacccatctgcgactttgccgtaattccaaaatatttattcaaatcataggtttcttttgtcggcccatactttatccagtatattgttccaccggcaagcccaatgacaactataaagatcaccagcaatgcaatacacacgtttctgacacggcgacgtctttttcttgctcttctccgtctctgataacctacgcccggatcctcgtatcttgcagcagcttttcttgctgccgcagctttgcgtctgcgctctctttccctttgctcattggtcattcttctttcgtccacatgacacctcctgtttgcagcatattttcacagcttaactaagcttgtaatatgcgcatactttaggttattataccacatatatctgccatttgtacacatctgaaagctatttccattccccacaggtcatgtcctggcgagggggctctgcttttttcattccacctgtgaatggtctgttcctatactgttaaaatccagttcccggatcattccctgttcatccagaatataatcccgcatataattactttcttctcttaccatatgcgctgacacgatctgaagcggacttgccggaaagccattcatctgcatccggacaccgctacgctcataatttgtcagttccgtaaataaatcctgatactttttctcttgctcgtccatatttcccccttgagtcagacagtttttacggcaaaaagcgaccataaggcaacacttgtgatatattacttctcctgtgctttttccgatgacaagaaaatgatcactgtccatacttcggttcaattgttaggttctgttgataaatcgtctgatatgacctgaatgtacttgattctgtacgctgtgtgcgaaatgcgtatgataaattcaagatttgtgcgattgactggtctgtcttattttcctgtaacactattataagaaagagtttataaaaaagcaagcattttttattttttattttgtttacatcgttccgttttttgtttatactattagtaattgttcagatagatttttgattgaataggaagtgatactttatgaagatagaaaagataaatgataatcagatccgctgcacacttacccgtgatgatctcgcccagagacagttaaagctcagcgagcttgcttacggctccgagaaggcaaagtctttattccgcgagatgatgcagcaggccgcttctgaatttggatttgaaagcgacaatctgccactgatgatcgaagcaatcccgaccgccggtgattctatcgttctgaatataaccaaagttgatgatccggatgaactggatacccgtttttccagattcacacctactcctgcggacgaagctgctgataagcacaaatccgtgctggaacatctgaaaaaacttgacggagccgaagattttctcgacattctccgccagatgaaagaggctgtatcccagctcccggagaacccggaagcacttgccgatactccggtccaggaacagactcctgcttcagaagccaaagaagcagctcctgctgaaccttctgttccaccggtccggcttttctctttctcaagacttgacagtgtgattcatgccagtcattttttagctgagatgtatgatggtccgaacacactttacaaggatgaagcagagaacatgtacatcctgacacttgcacagggagagcatccgtcttctgattttaaccggatctgtaatatgctctccgagtatggttcaccggaacagggtggtggtatatcacttgcatttctggaagaacactgtgatatgatccttgccaaaaacgcaatacagactctgacttcatttaaataacagacaaatccacaatttttaacttggcgaaaaaagacggggacggcagattaatgatctgtcgtccccgttaaattatatcttttatttattcacggtctatgcttcagctgctaagagtgcgttgatctttgcgataagaagatctgcatcaattccatgaaccattgctgcttcttcaagagactcaccctgtgaagccgggcatccaagacaatgcattccaacttccataagaaccggtgctgtctgtggagctacctgaagcaattcgccaattgtcattgtttttgttacttcgactgccatctttcttcctcctttacttttcgtatcccttattataataccatttatcccaaaaaacaaccttaatatccgactgtattgctcggatattaaggtttctttgcttttgtaaaatattttccccgttttccacaaaaaacgtatgtttttatgtggacaatgtggataacccacggaaattcagcattttcgcatttttcaaatgtctgctttcactggtgtttccaggctttttacacgattcttcttactgaaagaattgtcgtataagtcgccggtgaaatcccgattccctgttccgggttctgtgcattgacgatctgaccgttcccaatataaattccgatgtgcccatcataacagatcaggtctcccggcatcgcctgatcatagcttacctccacgccggcattgatctggtcatacgttgtccgtggaagactgattccaaaatgtgcaaatacagactgtacaaatccggaacagtctgccccatctgtcagacttgtgccgccccagacatacggatttccaataaactggcatgcataatcgacgattgcctgtccatttgacgccggctgtgcagaaacctcggtagtctccgtctgctgtacattttcctggacttcctgcgtcatctgcgcttcttcagattttctggacactgcataggtaaatgcttctgcttcttcttttccttcctgctgcgcttccgttaccagattctccgcatacgtctgcgcctctgctcctgtcagtatatattctgtttttacatatccggtgacatctcccgactcgactgccgtccattctcccacaggacctgtgatcttcgccgcgtatcccggatacagctttccgacatattcactttcctttgtcggttcgcttctgacatacagaaaactcgttacattggcaaatgccatatctaaatactcgcccttattttccggtaccagataatcctcagctttaatctccctgttctgagaataaaaatccttcaacaccgcttctatccctacgcccggcatttttgcagcttctgcggtgtccccatctgctgccataaccgaaattcccggagatactgtcatccccagaaaagtaaccaggaacaatcctttttttagatttgaatgcataaatctccctccttcatgtattcttatcttttgtaaatgttacagaattgttacatttgttacggtgatattatatcaatcaaatttcacattgtcaagttttcctcatttatttcgtattacacagttctacaccgttctttatatacattgttttttcgtcatatttgttacaaattgttacatctcgtttaacagtatttccattttttattcttttattcaatatacaattttttattgacattataagaatattattatactataattttagtaattattattattatcttttttgcaggaggtgacatcaatggcaaatttaaaatacagcagacagcgtgaggctattaaggattatctttcttctgttacaacacatccaacggcggatactgtatatatgcatatcaaagaagaattcccgaatatcagtctcggaaccgtttaccgcaatttaaatctgcttgccgacataggcgaggcgattaaaattacaacacccgatggcggcgatcgttttgatgcacgtaccaatccgcattatcatttctattgcaagtgctgcaagcgaatgattgatatggattttgatcacatggataagatcaaccagctcgcatccgaaagtttcgacggtcagattgaatcacacaccatgcttttctacggtatctgcggtgattgtttaagaaaatcctgactatgtggtataaattcagaaattttgaaaaaacttatcaattatagttgacaaagacaaatgtatatgttatcttaatatcagtaacagttactaatattgctaactaaaagaaatcaaatatactatcaaaaaaagaaaaggagattattattatgaagaaatttgtttgtacagtatgtggttatgtatacgaaggcgaagcagcaccggagaaatgtccagtatgtggcgtaggtgctgacaagttcacagaagtaaaagaaggcgaaagagaatgggctgcagagcatgtagttggagtagctaaaggcgtaagcgaagacatccttgccgacctcagagcaaactttgaaggtgaatgttcagaagtaggaatgtatcttgcaatggcaagagtagctcacagagaaggctatccggaaatcggactttactgggaaaaagctgctcacgaagaagcagaacacgctgctaaattcgcagaacttcttggcgaagttgtaacagacagcacaaagaagaaccttgaaatgagagtagaagcagaacacggcgcaacagcaggtaaattcgaccttgcaaaacgtgcaaaagctgcaaacctcgatgcaatccatgacacagttcatgaaatggcaagagacgaagcaagacacggaaaagcattcgaaggattactcaaacgctactttggctaagctacaagccgagcagggataaatagaagagcccctggaagaacgaatttattcattcttccaggggctcttctatttatccctattaggcgacagcctgcagcgagaagtagcgcagcgcattcgagctggctcgacctcctatttctggttcgccggctccacagccaccgtcttccctttaattttcacgttcttcatcgcgttcagtacctcacgggcatattccctcggcacctcaacaaatgtatacttatcatacatatcaatcgttccgatcagctttccatccattccgctttccccggcgatcgcaccaagaatatctcccggacgtactctctgcttcttaccaatattgatgaacagacgtaccattccgtcctcacctgcaccggtatctccaaattcccagtcattttcctctgtatttttattatcctctgtcattccacagcagatcttcaaaaatgctgctgccatatccatcgctgtaaattcagaattattgacacgttcttcgatcgcattgatcatcatatccagatcttcctgctcgatcacacgctccacatcatccagaatattttccatcttagtattcgcaacgtcattcagtgacggaactttctgtgcatagatcttcgtcttgcagtatctctggatctctttaagtttgtaaacttcctttcctgatacgaaagaaaatgctcttccttcgcgtcctgcgcgtccggtacgaccgatacggtgtacataatattcatcatcctgcgggagatcataattaaatactgcttccacttcatctacatcaattccacgggccgccacatccgtcgctaccaggatctctgtcttaccggtccgaaatccctgcatcacgcggtctctctgttcctgcttcatatccccgtgaagtcctgccgcaaaatatccgcgtccgagaagtgcatttaccagaagatctacctgcttcttcgtattacagaatacaaccgaaagccttggtgaataaatatcaagaagtctggaaagaacttcctctttcttcttcggctttacatcataataatactgctcaatattcggaacagtcagttccttttttgtaactttgatcacttttgcgttattctggaatttcttcgtaatctccatgatcggcttcggcatggttgccgaaaaaagcacagtctggcgctcctcaggaacaccacttaatacaaattcgatatcctcacggaatcccatgttcagcatttcatctgcttcatcaagcacaaccgtgtgtacaaaatccagtttcattgtctttctgcgcatgtggtccatcacacgccccggagttccgatgacgatctgtgttccactctttaaggaacggatctgctttacgatatcctgtcctccgtaaatcggcagaaccttgattccatgcatatatctggacaggttgcggatctcgtctgccacctggattgcaagctctctggtcgggcagagaacgatcgcctgcagctttttcagcttcgggtctaccttttccagaatcgggattccgaatgctgcggtcttaccggttccggtctgtgcctgcccgatcagatcgatcccgctaatcatcgccggaatcgccttcgcctgaatcggtgaagcctcctcaaatcccatgtatcttactgctttctgaatctcttccgaaagccccatttcttcaaatctaactgtttccatccattatcctttctactacaataccaattacaaatatgaccttaaactccatcatataaactctgccggggcgcattctcacgcctgcggcggtcgcttgcgccaacttccttatccgtcgcaatgcacaataaaaaactccttacttggtgacaatacaagtaaagagcatcgtaacattcgcgttatattctaacaaataatttttaaaaagtcaattttcacttgcattttatgcataaacggtataatatactcatatacttaatgtagtatttattactacatgtaatggttttaattattcatctctaaggagggatttgtgatgaaaaagaaacatattaaagatccaggaagtgcaatcacacattttatcggcatgctgatggcaattttcgccgcatttccacttttaataaaagcagcccacgaaccgagccggatttacctgatctcacttgcaatctatgcagtcagcctgatttttttatacgccgcaagcacaacctaccatacctttgatctttccgaacgtgtcaacacgatcctgaaaaagatcgaccatatgatgatcttcgtactgatcgccggaagctacacaccaatctgcctgctggtactagaacgcagaaccggacttatcatgctcgcacttgtatggggtatcgcaatcaccggaattattattaaagggttctgggtattctgcccgaaatgggtatcctccgtcctctatattagtatgggatggatctgtgtcctcgcattcaatcagatcctcaacaatctgacacgtgcagaattcggatggcttctcgctggcggaatcatttacacaatcggcggtgtgatctatgcactgaagcttccgattttcaacagtaagcataagaatttcggcagccacgaaatcttccacctcttcgtgatgggcggaagtgcctgccactttgttgtaatgtattctttattgtaaaccttgcatcctcgaaaaatccagaaatctcgccccactaaagctgcggaagtaattttttattctgcacgaaatgccaacaggagaagcaaatctgcttctcctgtttcatgccctactgccccgtctctttatagctcatcaccagcccaagcttcgccctccgcgtcatatgcttgatcgcatactcccgccgcatcgcctcttcctttgtctcaaactgctccagatacaccagctccaccggtctcctggatctggtgtattttgcgcctttcccggcattatgcgcttccagacgcttctcaatatcattcgtccacccggtatataatgtttcatccttgcattttaaaatatatgtataattcatcgcttcaaagagggaccaaaaagcccctcttcctttcttctgctcttattcttcagccagatagtccatcggattgaccggctgaccatcttttaacatctcgaaatacagattgcagccttccagactgtaatacttggtcggaatctccagatatccgatcacatttcccgcttccagataatcaccaactttcacctgcacttccttgagctgtccgtacatgcactcgtagccattccccatatccagtgtcaccgtgattcccgtctgtgcaaagttatcaatggattttacaatacccggtgctgctgcgatcacgttatcgttcaccgcaccggatatgatcatcgccggattatatcggtactggtccaatgtagaaaaatatacggttttatccatactgtagctcatcagcacattgccgtccaccggccacagaagctggctgtcctccccgaaattcaggttcattgccgttcctgcggtctgcgtgctgtccgtctcccatgtatccatccggttctctgtacttccatctgctgccgtatttgcagcctggctgtcctcttttgtcacaggttcttcatcttccagcgctttctttgcaatactgcttgtctcttccgtatttcttttgatttcttcctctttcgcctgctgttcttcctcgatctttgcctgctcatccttcacatttgcccggtaatttctccatgtataggctcctgtaagcacaatagcagcggcaaagcagaccgcaagaccgatcgacgctctttttctcctcttattagaggactgctgctttttattcatattctatcacctctgacaatatttttgccagaaactgactaacttattctcccttttcgtttttttcaatcacaatatccgtgacttcttccagactgacatcagtgaaaaaatatcgcagaatttcttcacaggattttccttcctctgccatcttctttgccgtgtactggctcatcccaagaccgtgcccgattccctttgccgtaacccttgttttcccgtcataatcctgaagcgtaaagcatgacgaggcaagatgataggttctccggaattcttcaccatttactgtttcactgccacaacggacctctgtcacatacccggcattgtctgttcctgtcacttccatgtcgcttccctggatcatggacactgtcatctcctcttttgcctccacatcttcgggacattccctgctctgaagatacggatactcttccgaaccaaacacttcatttccagaccttgtttttccgttgcttaaccggtgatacggagtcagaatcagccttccgtcatacatcagaacctgtccccttgtctcatcccacgcagctttcatcttctcataatattctccataatgatctgctccccagttgctctccatctgctgcctggtccagtattccttcgtcaggacagtgctggtgccctcatcctggatgcttttgtaaatgctggtccggatcaacactgcctgtgcctttaacgcttcctcctccgcatctccctcaatttctttagccagaatcccgatcccatattcatccagcgaaatttttctgttcttttcgtcactttttacggtcacatacgggctcgtcccattgtcctgcgccaaactgcttctgccattcagcagaatcgtaaccacatacggaagtaatataagaatggcagcaaaatagcctgcctgtctgaagtattttcgcataaataaaacctcccataccactgtatgagaggttttgactgattatgcttctggtttaactgtaacataatccagtttccagatattatcaacatattcctgaatggttctgtctgaagtaaatttaccacagcttgctgtattcagaagtgccatcttagcccaacgatccggatctttgtaagcttcttctactttcttctgtgcttctgcataagagcggaagtctttcaggataaagtatctgtccggtctgtctccaccctgtgtattcagaagtgaattatacaggtcgcggaacatctcatggtcaccatgtgaataagttccatccatcaactggtcaacgactctcttaatatcccagtcattgaagtagatctcctgcgggttatatccgccattattctcatagttgataacttcgtcagaactgaggccgaaaataaatgcattttcaattccaacttcttctacgatctctacattggctccatccatagttccaagtgtcggtgcaccgttcagcatgaacttcatgttacctgttccggaagcttctttggaagcggtagaaatctgttcgctgacatctgctgccgcgaagatccattctgcgttggatacgcggtaatcttcgataaatacgactttcaactttccattgatgctcaggtcattatttaccacatctgctacagagttgatcagtttgatgatctcttttgcacggacatatcctgcggaagcttttgcaccaaagataaatgttctcggatagaaggacatctccggatgttctttgatctggttgtacagatacattacatgcagaatattaagaagctgtctcttatattcatgaagacgcttaacctgtacatcataaatagatctcggatcgatctctactccattgtgttccagaatatattttgcaagacgttctttgttcttgtatttgatatccataaattctgctcttgccttcggatcatctgcaagcggttttaattttgacatctgggacagatctgtgatccagccgtctccgatgtggtctgttacccagtctgcaagcagcgggtttccatgaagaaggaatcttctctgtgtgataccattggtcttgttgttgaatttctccggcatcatttcgtagaaatcttttaattcctgatgtttcagaatctctgtatgaagtcttgcaacaccatttacggagtagcctgcaataatagccatatgtgccattcttacctgaccgtccatcaggatagccatcttacggactttatcttcattgcccggatacatacggcgaacctgttctacaaaacggcgatcaatttcctgtacaatctggtatacacgcggaagcagtcttgaaaacaggtcgatcggccatttttcaagtgcttctgacatgatagtatggttggtgtaagcaaccgtctttgttgttacttcccatgcttcatcccatccaagaccttcctggtcaatgagcagacgcatcaactctgcaactgctacagtcgggtgagtatcgttcatctggatcgtaactttttcatacagtttgcgcacatctttgtgtttctttttatatttatcaagcataacctgaagactggcagatacaaagaaatactgctgtttcagacgaagctcttttcctgcatagtggttgtcatttggataaagaacctctacgatcgtttttgcaaggttttcctgctcgatcgctttatggtattctcctctgtcaaatgcatccagtttaaagtctgtgattgcctgtgcatcccagatacgcagtgtattgactacgtggttgccatatcctacgatcggcatatcatatggaatagcaagtacggattcataattttcctggatgaaatcttctttcttggtctgttcattatactgtacacgaatggtaccaccaaaacggacttcctttgcatactcgtcacgacggatttcaaacggattgccatctttgagccagttatccggtacttctacctgatagccatctttgatcttctgtttgaacataccgtagcggtaacggattccacagccgtaagctgcgtatctaagagatgcaagtgaatccaggaagcaagctgcaagacgtccaagaccaccattaccaagtgctgcatccggctcctgatcttctaccacattcagatcaatgcccatctcatcaagggcttcttttacttctttatatgcagtcatgttgatcaggttgttgccaagtgcacgtcccataagaaattccattgacatataatatacggtctttggatcttctttttcgtatgttttctgtgtcgcaagccagtcatctacgattgcttcttttactgcataagatactgcctggaaaatctgctgcggagttgcttcttcaatctctttacgatacagtgtccgcacattttctttcacatcatttttaaaagtttctttttcaaatcttttactgtacatgcttatattcccttctcattttgcgcagctgcagggattattctccctgcttttctacacccatatttacagcttcaccgttgatcttccagtctttcacatagcctgcaggttcagccttttcaactgctaccgcaagtgtctcctgtccgatctgctctgcatactctgcaaatactttttctgctttttcgcttccgtcgtaagttaccttgatcttgtccataacttcaaatccggcttccttacgcatagtctggatcttactgatgatctcacgtacaaatccttctgtcagaagttcttctgtcaggtttgtatccagtacaacggtgataccatagtcactctcagatacatatccttccatctgtgccatgtcgatcagaaggtcttcttttgtaagttcaatttcctgtccatttacctgaagcttcagaacacctgtcgcattcagttcgtccatagcagcatttccgtccagactgctgagttcatttttgattccacctaacagtttaccatattttggtccaactgtctttaattgtggtttaaatgtataagaagtaaatgcacgaacatcatctgtaagttcgatttcttttacattcagctcatctgtcacgatatcctgatagaactccggcagatcggaagcaccttttacgaacatctttccgattggctgacggttcttgatgttggctgtattacggcatgcacgtcccattacaacgatcttcagaacttcatccatgttctcttccagagtcttatcgatataagcttcatttgcaaccggataatcacaaaggtggatactttccggagcggtttcatctacgcttcttaccaggttctgataaatttcttcggtcatgaacgggatcatcggtgctgcaacctttgataccgtaacgagtgctgtataaagagtcatgtaagcattgatcttatcctgttccattccttttgcccagaaacgttcgcggcttcgtcttacataccagttactcatatcatctacgaagtcctgaagtgctcttgcagcttccggaatctggtaatttgcaagatgattatctactgtcttgatcagtgtattcagttttgataagagccatttatccattacagataatttgtcatattcaagtgcatattttgttgcatcaaaatcatcaatattagcatacaatacgaagaatgcataggtgttccagagtgttcccatgaactttctctgtccttccataaccgcttttccatggaaacggttcggcagccacggtgcactgtttacatagaaataccagcggatcgcatctgcaccgtatgtctccagagcatcaaacggatcaaccgcatttcctttggatttactcatcttctgaccattttcatcctgtacatgtccgagaacgattacgttctggtatggtgctttgttgaaaatcagggttgaaattgccaacagagaatagaaccatcctcttgtctggtcaacggcttcagaaatgaactgagccgggaactgctgttcaaatacttctttattttcaaatggatagtgatgctgtgcaaacggcatggatccgctgtcgaaccagcagtcgataacttccggtacacggtgcatctgttttccacacttcggacacttgattgttacatcgtcaatatatggacggtgaagctcaatatcatccgggcagttgtctgacatggatttcagttcttcaatgcttccgatcgagtgctggcatccgcattcgcattcccagatattcagtggagttccccagtaacggttacggctgatcccccagtcctggacattttcaagccagtcaccaaaacgtcctttaccaatgctttccgggatccagttgatagtattgttatttgcgatcaggtcatctttaacttctgtcatcttgatgaaccatgattctcttgcatagtagatcagtggagtatcacatctccagcagtgtggataactgtgttcaaacttcggagcatcgaagagaagtccacgagcatccagatctttaagtacttccggatcagccttctttacaaagagtcctgcaaatggagttgtctcacccatatcacctttttcgtcaacaagctgcacgaatggaaggtcatatttgcgtcctacttttgcatcgtcttcaccaaatgctggtgccagatgaacaacaccagtaccatctgtcagagttacataatcatcacaggtaacaaagaatgctttctttttctgttttgttgcgcagtcatatgcacactggtaaagcggttcatattctttgtattccagatcttttcctttgtaagtttccagaacttcgtatgccggtttgtcttcttctgcaaatttcccaagaatggtgtcaagcagagcgcatgccatataataagtatatccgtctgcacattttacttttgcgtaatcttcttccgggtttacgcagagtgcgatattagacggaagagtccaaggtgtggttgtccatgcaaggatgtatgcatcttcgtctttcactttgaaacgaacgatagcagaacgttctttgacgtccttatatccctgtgcaacttcctgtgctgaaagtggtgttccacaacgtgggcaatacggaacgatcttaaatcctttgtaaaggagtcccttatcccagattttcttcagagcccaccattcagactcgataaagttattatcataagtaacatatggattttccatatctgcccagaaacctactgtagaagagaaatcttcccacattcctttgtatttccagacactttctttacatttattgataaatggttctacaccatatttttcaatctgatcttttccgtcaagaccgagcagcttttctacttccaactctaccggcagtccgtgagtatcccatcctgccttacgcggaaccatgtagcccttcattgtacggtatctcgggatcatatctttgattacacgggtaagaacgtgtccgatatgcggttttccatttgctgtcggaggtccatcgtagaaagtataagtttctccttctttacggttctccatacttttcttgaaaatatcttcttcattccagaatttttcaacttctttttctctgtctacaaacttcaggtctgtatccacttttttgtacttagccatgataagctcctttctgaatcaatgactttgtatgcattttttggtatatagaaaaatgtgccccggcacgtagtgcccttaattttgcaggaagtttttggaatttcctgcaaaattaaaaaagactttcacccgtaaaaggacgaaagtctgtacatcgttaaccacctgttactgcataccagcatatgagtttcctgtaacgggggaaataaccgtcagaacttactcgccagactgctttcagttactgcaactcggaagtgatgttcagatctaccctacttgcaccggtcttccaccatctccggttcgctttacctttcaaataaaccttactgtcttcgtcaatgtcttttgatcttttttcaccatttctaggttattataataaagaaccccttgcttcgtcaagggggtctgcgggatttcgtgattctttccttatatttgactgaccagacgttaatctttgtcaacttctcttctgcgctttctgtttgtttccactttcttctttctcaagtgtttcagaacagccctccatacaataataagaatgagtactgctgcaatcacacagattacaaggattacctctcgtggtattgtgctctgaacctgcttttgtgtttcactgtctgacttatcgccggacacctgtgcttcattttctgtgttatctttctgcagatattcatcacttaatgtcacagctgcttttccgaccgggttgccctgataagtataagttactgttccggtgctgctgttcgtgtcatcctgcgtaatttcgtaatccaggctttggaaatttacattttccggaagtacaacatatgcattcggatcaatttctttaaaatctgcggagtcttcataatccgcaatcgcatattttgcgaaattattaaatccatactccagtaaattgatggagtctgggtatacatttttcccatgtgtcttcaagacaacactgatcagctccagattatcatctgctgcacaggataccaacgtgttgagtgcttcatctgtataaccggtttttccggctattgtctttggataataataatcgtttccctcgtaaaacatcagatcactctgttgaaaggttctcgcctgatttaccagattggttgcaccgatcgtatactgctgtgtctgggcaatcgtcttgaattcttcatgattttcaagcagttcctgtgtaataagtgccatatcacgtgccgtcgtataatggttctgcgcattcagcccattcggattttcaaaatcagaatttactgctcccagctcttttgcgcgttcattcatctttgcaataaagccatcatatcctaaaccacccacattttcagcaatcgcataagcaacttcatttgcagatgccatcagaagtgcgtgaagcgcatcatttaaagaaatttcctcccccgcgatcattccgatataagcatccccctctgctacacaatccacactattctgtgtaatcgtgatcttgtcatcaagattgccgttttccaatgcgacaagtgccgttaaaatctttgtaatactggcaggataagcctttccgtcaatgtttttcgcataaaggatcgcaccgctttttgcctccatgacaatcccagcctctccgtaagtagccggtccttccggccagttctccagctcattgctggcaatcttcatatcatatgcctgctgtgttacttcatcgattttctgctgctgcagggctttaatttcttcttgattttttccggaagtttcttcctctgtcagattataattgctgaccgttgtatcaattggttcatttgctgacgtatcttctgcaaatgcggtcattccaagacttccaaccatcactgccaccagcgatgcacttaaaattttcttccatctcctcacggatcttctcctccaaattctttaatcttatctaataaatccccgatatctgttcagacatgcgtaaatatcctgtttacggatctgtgccattgatacagaaagataacttcctttgcaaagggatgccagaccctgcttcttaatctgactccagagcttttccacgcaaagatcaacatcctgttccttccgttccatttcttccagcagattcttcaggcagtacgctaatgccgttgtctgttctgcatccaggatttgttctacatatttcagatccacattttctcttccaatagaaaatgaatctttaccaaactgttttatcttcacctgatctctcttcttttccatttttccggcctttaagcttctgtgatgatctttatcaaataagacagctacatcaaccggaacctttttctctctggtctcacttttttcaccaatcaccgttttcactttttctgtgatatcgtacgttcggtaattatccatctgcagcacatgatcagcaatgtaaaaataagatccagaacttccggccaccagaataatagaaattccctgcttttgatacaggttacctgcctgaagagtaaatggtgtaatcggttcctgttcgccggatacgacagcctgcatcagctcatccctgaccataaagttcgtcgcacaggtgtcttcatcgatcaaaagacattttgcacctgactgtaccgcttctaccacatttgcagcctgcgaagtcgaaccactggcatcctctgtgaaaaaatttactgtatctttcttattcggcagatcattgataaacggtgaaatattgatatgggatacacatcttccgtcctcggcccggatcttcatcgcagtatccgaagtaatcacgtattctcttccatctccggcgacgtgattgtaaattccctgttcaagtgccttcagaagtgttgattttccatgatatcctccacccacgatcaaagtaattccttccgggattcccattccttttattttaccccggtgtggaagttccatctctacttccatactttccggtgcttcaaaagcaattgcacctttcataggcttctgtgatacaccgctttctcttggcagtatagaaccatttgccacaaatgcaataagtctccgctttgtcagttctcttcttatataatgttgatcttccgcaagttctatacactttttcacttcctgctgattcaggttcttataatataaagatctgtcagctatttccggaagatactcaaacaaaatctttctcagttcaaatgcattgatcgtccgtccatttgccggaaatccaacttcaaaccgtaccagaagatctccatccttaatttcaaatgcagtcctgtccagaacctcctgtccacagcggcttatcccaatcaatccacttttcccggaaccctttgcctggaaaataaatttggaaacagcttttccgaattgtcttgtcagataatcctgaagcgcaattcttctgtgttcttctttataatattcttctggaaatctcgcctggattttcttcacctgaatactcagctttgacggagaagcaaatggatctccttgtacatgatcaatattgagctggtatccctgaaactgatagcttcctctcaaatctttgtaagctggatagcttcttcgattgatactcatcaaatttttttctaattctgctgctgatttcatatcttgctccctcttatcaaattctatgatgttggggcaagaggtcaaaaatcctcttgcaggcaagtttgcatcggctttctgaccttttgaccctggtatcattctattttactagcaaaaatttacttggtgcatattaaattttctataaaacgaaaaaagatgtaaacccaatttatacaggatttacatcttctaaatcatgaagcatcggggattcgaaccccggacaacttgattaaaagtcaagtgctctaccacctgagctaatgctccatctgttatacagcttgccttctttcgaagacagtgcccagaaccggaatcgaaccagtgacacgaggattttcagtcctctgctctaccgactgagctatctgggcatacacactaatgtgtgagttgcgggagcaggatttgaacctacgaccttcgggttatgagcccgacgagctaccagactgctccatcccgcgatgatatctcattatagcacattttttctaaatatgcaatgggcggaggtggattcgaaccaccgaagcaaattgcagcagatttacagtctgtcccctttggccactcgggaatccacccatatgaagttttactgtcttccaacagacatcattcagattaactgtctgatgcaagccgatgatcggactcgaaccgataacctgctgattacaaatcagctgctctgccaattgagccacatcggcatatcaatgggaccaatagggctcgaacctatgaccctctgcttgtaaggcagatgctctcccagctgagctatgatcccatgataatttaattaagcaatcaacactaagtgtttcctgcaagcgacccgaatgggactcgaacccacgacctccgccgtgacagggcggcgctctaaccaactgagccatcgggccttatttaaaggcatttcatgtaccttcaaaaccacatacaaatttaaatctttactccatccattcttccttaccctgtcctaccttcttggttatgccctcgaccgattagtaacagtcagctccatgcattactgcacttccacctctgccctatctaccttgtcgtcttcaaggggtcttacaacttacgttgggatatctcatcttgaggggggcttcacgcttagatgccttcagcgtttatcccttcctgacttggctactctgccatgctcctggcggaacaacagatacaccagcggtcagtccagcccggtcctctcgtactaaggccagctcctctcaaatatcctacgcccacgccggatagggaccgaactgtctcacgacgttctgaacccagctcgcgtaccgctttaatgggcgaacagcccaacccttgggacctacttcagccccaggatgcgatgagccgacatcgaggtgccaaaccactccgtcgatgtgaactcttgggagtgataagcctgttatccccagggtagcttttatccgttgagcgatggcaatcccactttataccaccggatcactaagtcctactttcgtacctgctccacccgtcggtgtcgcagtcaagctcccttctgcctttgcactcttcgaatggtttccaaccattctgagggaacctttgagcgcctccgataccctttcggaggcgaccgccccagtcaaactccccacctgacattgtcccccagccgggtcacggctgctggttagaaatccaatactgcaagggtggtatcccaacagcggctccgcatcaactggcgtcaatgcttcttcgcctcccacctatcctgtacatacaatatcgaatcccagtatcaagctggagtaaagctccatggggtctttccgtcctggcgcaggtaaccagcatcttcactggtatttcaatttcaccgggtgcattgttgagacagtgcccaaatcattacgcctttcgtgcgggtcggaacttacccgacaaggaatttcgctaccttaggaccgttatagttacggccgccgtttactggggcttaagttcaaagcttcgcttgcgctaacctctccccttaaccttccagcaccgggcaggcgtcagcccatatacttcaccttacggttttgcatagacctgtgtttttgctaaacagttgcttgggccaattctctgcggccagctctcactggcactccttctcccgaagttacggagtcattttgccgagttccttaacaatgcttctcccgtcggccttaggattctctcctcacctacctgtgtcggtttacggtacgggtacagtacaaacaatagcggcttttcttggcagctggctcacacatttccctacttcagttcggtatgcatcacgtcttcggattgtcacgcggatttgccagcgcgactcctacctcgcttgccgcgggattccattcccgctagtgctctccctctgcgtccccacagttctgttatactgcagtacaggaatttcaacctgttgtccatcggctacgtctttcgacctcaccttaggccccgacttacccagagcagatcagctttactctggaaaccttgggtattcggccggaaggattctcaccttcctctcgctactcattccggcattctctcttcttaaaagtccacagctccttccggtactgcttcttccctttaagaatgctcctctaccaattaactacgttaattcctgagcttcggtagtgtgtttcagccccggacattttcggcgcaggacctctcgaccagtgagctattacgcactcttttaatgtatggctgcttctaagccaacatcctggttgtctttgaaatcccacatccttttccacttaacacacattttgggaccttagccgcaggtctgggctctttcccttttgactgcccaacttatctcgtgcagtctgactcccatgaatcatcttactggcattcggagtttgatatcctttggtaagctttgacgcccccgcgggaattcagtgctctacctccaaaagactctcatgaggctagccctaaagctatttcgaggagaaccagctatctccgggttcgattggaatttctcccctatccacacctcatccccacccttttcaacggatgtgggttcggacctccattgccttttacggcaacttcatcctggacatggatagatcacccggtttcgggtctactccatctgacttaacgccctattaagacttgttttcacttcggctccattccttaagaacttaacctcgccagatggcgtaactcgccggaccgttctacaaaaagtacacggttcatcatatatagatgttccacagcttgtaaacacagggtttcaggttctctttcactcccctcccggggtccttttcacctttccttcacagtactatgcgctatcggtcactaaggagtatttagccttacggggtggtccccgctcattcccacaaggtttctcgtgtctcgtggtactctggatcccgccttgctgactcgtctttcgcttacggggctttcaccctctctggctggctttcccaaaaccattctgctaaacttatcagatcaattacgcggtccgaaccccggaatgcacgcattccggtttgggctcttccgttttcgctcgccgctactcacagaatcacttgttgttttctcttcctccggctacttagatgtttcagttcaccgggttcccttccatacgttatggattggcgtatggatgactggagtctgtccagccgggtttccccattcagatatctccggatcattggatatttgctcctccccgaagtttttcgcagcttatcacgtctttcatcggctcttagtgccaaggcatccaccctgcgctctttctagcataaccaactcccttctcccacgggaatgggatccggttacacatgcatagcgttgcatgcgttggtatttcaggtcgtttttttacttcgttttctcgaagatgtaagttaatcattaccttgcggtgatgatcacctcggatgtctttctctatttgagaattgatttatttttgtatgcagttttcaatgtacatgcggttctttcgaacctagtggagaatacgagattcgaactcgtgacctcctgcttgcaaggcaggcgctctcccaactgagctaatcccccatattcaattatcttttaaagaagtgggcttaagtggactcgaaccaccgacctcacgcttatcaggcgtgcgctctaaccggctgagctataagcccttccttttataatctggcggccacctgctctcccacaccgtctccagtgcagtaccatcggccgatcaggtcttaaccatcgtgttcgggatgggaacgggtgtgtcccctgaccgcatcgccaccagaagtatctgagttttgataactcaacaatagacaacgaactttccttacttcttcttccttagaaaggaggtgatccagccgcaccttccgatacggctaccttgttacgacttcaccccagttatcggtcccaccttcggcagctccctccttacggttgggtcactgacttcgggcgttaccaactcccatggtgtgacgggcggtgtgtacaagacccgggaacgtattcaccgcgacatgctgattcgcgattactagcgattccagcttcatgtagtcgagttgcagactacaatccgaactgagacgttatttttgagatttgcttaccctcgcaggtttgcttccctttgtttacgccattgtagcacgtgtgtagccctgctcataaggggcatgatgatttgacgtcatccccaccttcctccaggttatccctggcagtctctccagagtgcccatccgaattgctggctactgaagataagggttgcgctcgttgcgggacttaacccaacatctcacgacacgagctgacgacaaccatgcaccacctgtcaccggtgttccgaagaaaaggcatcattacatgccggtcaccgggatgtcaagagcaggtaaggttcttcgcgttgcttcgaattaaaccacatgctccaccgcttgtgcgggtccccgtcaattcctttgagtttcattcttgcgaacgtactccccaggtggactacttattgcgtttgctgcggcaccgaagagctttgctccccgacacctagtagtcatcgtttacggcgtggactaccagggtatctaatcctgtttgctccccacgctttcgagcctcaacgtcagtcatcgtccagtaagccgccttcgccactggtgttcctcccaatatctacgcatttcaccgctacactgggaattccacttacctctccgacactctagctgcatagtttccaaagcagtcccggggttgagccccgggctttcacttcagacttacacagccgtctacgctccctttacacccagtaaatccggataacgcttgcaccatacgtattaccgcggctgctggcacgtatttagccggtgcttcttagtcaggtaccgtcattttcttccctgctgatagagctttacataccgaaatacttcttcgctcacgcggcgtcgctgcatcagggtttcccccattgtgcaatattccccactgctgcctcccgtaggagtttgggccgtgtctcagtcccaatgtggccggtcaccctctcaggtcggctactgatcgttggcttggtaggccgttaccccaccaactacctaatcagacgcgggtccatctcataccaccggagtttttcccactgagccatgcggctccgtggtcttatgcggtattagcagtcatttctaactgttatccccctgtatgaggcaggttacccacgcgttactcacccgtccgccactcagtcacaaacctcttcatccgaagaatcaaagataagtgcttcgttcgacttgcatgtgttaagcacgccgccagcgttcatcctgagccaggatcaaactctcgttaaaaatgtttgtatccgggtcagaatcgcttggcaattctgttcctgtttactgttctggttcgacatctttcgatgtccgttcttgaaaaatctctttaaagaattttcagggtttgttgtctattgttcagttatcaatgttcttttttgttgttgccgtttcatgcgacagcttttatattatatcaaagcatttcatgtttgtcaacaacttttttaaattattttttgttgcttttttgaatctctcgaacagcaactctgatatattatcatatatcttcttgcttgtcaataacttttttgaagtttttttcaaaagttattttcaaacaaaacggagaaagagggattcgaaccctcgcgccggttgcccgacctacacccttagcaggggcgcctcttcggcctcttgagtatttctcctcagcccgatccaaggtctgtatttaactgcgtgtttacatacttttaatgtaacttcacagcgcattgataattatacctaagaaccctttttctgtcaacggttttttcgattatttttttctttttttaagtttgttttctaattatctatatatagaagaagcagactctttttcactatatctagcaaagagtctgtcctttttaccttatctttattttatgcttcctttggttcatattcagatatggtttcttctattcttctttttacttcttttgcgatctctgtcgtcttcatattttgatattcttcataataaatcggttccaggaaatgtacctgtaccgttaccggtgcgatactatttgtatcaaacggtttaaaagaatcgatcaacgcaatcggtatgatcgggcatttcgcttttgttgccgccttgaagcttccacctttaaactcaagaagcttgttccccatcttcgagcgggttccttctgcaaagatcagatagtttcttcctttcttcacttcctctgtaacatccatgatcacttgcatagactgacggatatcttcgcggtcgatcatgtaggccttcatacatttaaatgtctgcttgagaagtggaacatttgccacttctttttttgccaccaccgaaaacggacgcgggcaggcatcaacaattgcgagtacgtcataaagcccttgatgattcggaaaaaacataaaccctccctctttggggatattttcttttccatatgcttcgattgttacatttccgcctttattggctcttttgacaatatatttcagaagcttatatcgggtgatctccggatacttgtctacgtgcgcggcatagtaacacagcttgcaccacataaacggaacaagcagaatattccgaattaccataagtgcaattcttttcacacaattcattccctattcctccgcatactctttgacggctgtctcgtataaattattgccctcggagtcgatcacaacaattgccggaaggtcttcgatctccaggcggcggatcgcttctgtgccaagatcatcatatgcgatcacatctgctcttttgatacattttgaaagaagcgcgcctgctcctccgactgccgcaaaataaactgctttatttctcacgattgcatcctggacagcctgacttcttttcccttttcctatcattccgccaagccccagatccagaaggcgtggtgcatatttgtccatcctgcttgctgttgtcggtcctgctgagccgatcggtcttccttctctcgccggagatggtcccatataataaatcatctgattcttaatatcaagtggaagctcttttccttctgaaagcacttcatccattcttttatgagcagcatcacgggcggtataaataactcccgtaagatatacataatctcctgctcttaaatcctgtatttcttcctttgctactggaactgtaatatgtctttccatattcttttccttcctgattctttttctgtattctgctgcggcgtttttaactgctaacaggagtcttataatcctcttaaaataatttcagccagtttctcaactgtaaagtctacaaaactaatgcactgcgcttttctctccggagaatttttttcttttcctcttgtcagcacacgacagcaggttgctccgcaatgttctttaaatgcgtcgtgaaactctttcgtcagccgctggcatttcaaaaaggcttcatctccaggtgttcttcttccgaaaaaatagccgatgcacatggttgctcctgcaagcgcaccacaaatacagccaccatctccgagcccccacgggaatccggatgacatagcgatcgcatcatctgacagatcaagatcaaagccctttttgatcgcatagatcaccgactctgaacaggcgaaccctttctgaaaaatctcaaccgcatcttttcgcattgcgtctacatctacatttgtattcataattatcctcttttcattttcctttaaatattacacatcctctcaccgggcagaaaccatttgtaacatgcttcatcttcgcacgagtacatatcttcggcacggaaagtcttttcaagatccccccggtaaattaaatagtgcggatcacatggcggttaacatgacagcaaatatttacagctaccggaagtccggcaatatgagtcggataagtgttgacattgacagccagcgcggttgtacttcccccaagtccgcccggtccgattccaatcttgttgatccgctccagtaattcttcttccagttcttttacatatggaatgtctgaatggcttccgacttctcttgtaagtgcttcttttgccatcagtgcgcatttttcaaatgtgccgccgattcccacgccgacaaccatcggaggacaggcattcgggccggcatcttttactgccgtaagaactgcttcctttactccttcgattccgtctgccggtttcagcataaatacacggctcatattttcgcttccaaagccttttggtgcgaccttgatcttcacctgatcgcccggaacaattttataatgaatgattcccggtgtattatcttttgtattctctctgagaatcggatctttcacaacggattttctcagatatccgtcaacataaccccgacggatcccttcatttaccgcatcttccaggttgccgccttcgaaatgtacatcctgtccgatctcaagaaatacgactgccattccagtatcctggcagattgggatcatatcttttccggcgatcttcagattatcctgaagctggcttaatatctttttccccagtggtgacttctctgttgaaactgcatttttcatcgcaatgtccatatcttttgaaagaaaatggttcgcttcaatgcacatttctttgatattctttgaaatctcttccacgttcaatgtacgcattggtttttcctcctgcatttcataatctgatttttattatactatggttttttttcatctgcaatgtaatcatcttcaaataaaccagtattgcctctaattgttaaccttgtaaaattttaagttgacattctttcttttgcatggtaaagtgtgaaatgtatttgatattttttaccaaggaaggtttacttatgatttctgaaattgaaacaactacagatccggtgctttcacgagaagatgcgattgcaatcctgaatacaccggacgaagaactcgatcagctcattgcacaagctgaaaaactgcgcagaaaatataagggcaatcatgtaagtattcatattcttaccaatgcccgcagcggtaactgctcacaggactgcgcttactgtgcacaatcctgtcgttcaaaagccgatatcgacaaatataagtgggtagctgatgagaagttatataaagataatgattttgtaaatgaacatcatctttccagacactgcatcggactcagcggtatgaaattcaccgacgaagagatcgaagaactggcttctaagatccgcaagatgaaggaagacggaacccacctttgctgttccatcggatttcttactgaaaaacaggctctaatgttaaaagaagccggactcgaccggatcaaccacaacctgaacagcagccgggcttactacagtcatatctgttctacccatacttttgagcagcgcgttcagaatatcaaaatgcttcagcgacttggatttgaaatctgcagtggcggaatcattggaatgggcgaaagcaaagaggatgttgttgatatgcttctggagcttcgtgagatccagccggaagctctgccaatcaacttcctgttgccaattccgggaactccgctcggtgatgccgatatttccgaactcacaactgaatattgcatgaaggttctctgccttgcaagacttctggttccgcagtcagatatccgttgtgctgccggacgtgaggtttattttaaaggtgaagaaaagaagcttctcagcgttgtagattccatcttcgcttccggttatctgaccgcagatggtcagggaatcaaagatacgatccggacgattacggatgccggttttacatatgagatcgaatctgcttaatttattgacacgccgaacattattaacattctaaaaggagagtacataacatgactcagggaaacacacagacacttcgtacaaccaatacttatgcaatggcggtaacagctcttatgaccgctgtcacctgcattcttgcaccgctttccataccgatcggaccggtgccgatttcacttaccaactttgcaatttatctttctctctatcttctggattggaagaaaggaacgatcagctatatcctttatcttcttctcggacttgtgggacttcctgtattttccggattcaccggaggaatcggaaagcttgccggaccaactggcggatatatcattggtttcatcccaatggcaatcattgccggtattgtaattgacaaattcagtcagagatggatccagattcttggaatgatcgttggaaccgcaatctgctatgcattcggaactgcatggttctgcattcaggcaggttacactgtatctgctgcccttgcagtatgtgtcattccatttatcccggcggaccttatcaagatggtgatcgccatgatcatcggacctgaaatccgcaaaagactcggagctgttgcacagtaagatgcacggcgtctgccagaatatttgaagtctggcaaaataataattcagccccctctacaaagtccggaaagcctgtttgctgcagcgtttccgggcttctttgttttttaatccggcttttaccagagcaaacgcaagccatgccataacatttctttccatgcagcctcacaaaacaaagcaagagaccagacaaggcatttgcatattccctgtccagtctctttatgatttatcctgcttctgtatttctactttcgctcagatctttattcttctgtctgctcttctacaaccgtctcagcagttgcttctgtatttgcttcttctgcagtctcttctgcgttctcctccagttcacctgaagccctgcgtacctttgcgatacttgcaacttcttcgtgttccttcagattgatcagtttaacaccggatgtgattcttccgagtacggaaatccccgcacattccatacggatcacgataccatctgtgttgatgatcataatctcatcatccggacctactgcctttgcaccgactacatttccggtcttctctgtgatcttatagcatttcacgccttttccaccacggttctgggctgtgaattcttccatgcgggttctcttgcccatacccttttcagatacgatcagaagctcttcaccctgcgcatcaagctgcattgcaacaacttcatcacggtcacttaaattcataccacgaacgcccatagaggttcttccggttgagcgtacatcagattcatggaaacggatgcattgaccatactgcgtaacgagaataacatctctttcatcatccgtaatcttaacttcgatcagttcatcatcctcacggagtgtgatcgcagcaagtcctgtctttcttacatttgcgtaatccaggatcggagtcttcttaacaagacctttcttggttgccatgaacagatagtcaccttccttgaaatccttaatcggaatcattgctgtgatcttctcatccggctgaagctgaaggatgttgataattgctgtacctcgggaagttcttcctgcttccggaatctcatatcccttcaggcgatagcagcgtccggtattggtaaagaacataatatactggtgagtattggtcatgaacagctcttctacataatcttcatccagagtctgcatacccttgatacccttgccgccacggttctggctcttgaaagtatcgttgctcattctcttaatatatcccatcttggtcatggtgatcactacatcttctctcgggatcagatcctctgtagaaatgtcgtattcatcaaatccgatggctgttcttctgtcatctccgtatttttcagagatcacaaggatttctttcttaattacgccaagcagaagctttctgtctgcgaggatcgccttgtactctgcgatcttcttctcaagctctgcatactctgtttccagcttctctctttccagaccggtcagagctctcagacgcatatccacgatagcctgggactgtgcatcacttaagttaaagcggctcatcaactctgctttcgcaatctgtacggtcttggatccacggatgatcttaataacctcatcaatgttatccagggcgatcagcaaaccttccaagatgtgtgcacgttcttctgccttattcagctcgtatttggtacgtctggtcacaacgtcttcctgatgtttcagataatggttcaggatttccagaaggctcataaccttcggttcattattgaccaatgcaagcatgatcacaccaaatgtatcctgcagctgtgtatgcttgtaaagctggttcagaacgacattcgggttcacatctcttctcaattcgatgcagacacgcataccttcacggcttgactggtcgctcaggtctgtgattccatcaatcttcttatctcttacaagctccgcgatcttctcgatcaggcgggctttgttgaccatatacggaagctcggttactacgattctgtgctttccattctgcattggctcgatattggataccgcacgcacacggatctttccacgtcctgtacggtaagcctcttcgattcctcttgttccaaggattgttgctcccgtcgggaaatcaggtcctttgatgatctccatgatctcttcgatcgtggtctcacctttatcttcaatctggtcatcaataattttcacaaccgcaccgatgacttctcttaagttgtgcggtggaatattggttgccatacctaccgcaataccggaagttccgtttaccagaaggttcgggaatcttgacggaagtacggtcggttctttttctgtctcgtcaaagttcggtgcaaaatcaacagtatctttattgatatccgctgtcatttccatcgaaatcttactaagtcttgcctcggtatatcgcattgcggcagcaccgtcaccgtccacagaaccgaagttaccgtgaccgtctacaagaatgtaacgggtagaccagtcctgtgccatattaacgagggctccgtaaatagaactgtcaccatgcgggtgatatttacccatggtatcaccgacgatacgcgcgcatttacggtgcggcttgtcaggaccgttgttcaactcgatcatcgaataaagaatacgtctctgaacaggtttcagaccgtctcttacatccggaagcgcacgagaagcaataacactcatggcataatcgatatagaactcttccatggtttttttcatatccacttcatgaactttatcaaaaatattatcttccattggtattctcctatatatctaagttcttaacaaattttgcattctcttcgataaattctcgtcttggttctactttatctcccatcagggttgtaaaggtaagatccagttcggaagatgtctcatcgtccattgtcactcttcttaagattcgatgctgcggatccattgtggtatcccataactgctctgcgtccatctcacccagacctttgtatcgctgaatcttattgttctgatcacgtccgacttcgctgatgatcttcgccagttcttcatcgctgtatgcataccagactttcttgttcttctccagcttgtaaagcggcggctgagccagatatacatagccctgtttgatcagctccggcataaaacgatagaggaatgtcagaagcagcgtactgatatgtgctccatcaacgtcggcatcggtcatgatgatgatcttgtgatatctcagtttggaaatatcgaaatcatcatggattcctgtaccgaatgcagtgatcattgccttgatctcggcattaccgtagatcttatccagtcttgccttctctacattcaggatctttccacgaagtggcaggatcgcctgggttgctctgtcacgggctgtctttgcagaacctcccgcagagtctccctctacgatgtagatctcacacttggatggatccttatctgaacagtccgcaagctttccaggcagtgacatgccttccagtgcggattttcttctggtaagatctctcgcctttctggccgcctctcttgctctctgcgccataaccgacttctcaacaattgattttccaatagcaggattctgttcaaggaagatctgaagctggctgctgacgatactgtcaaccgcacctctcgcttcactgttaccgagcttctgcttggtctgtccttcaaactgaggatcctcaatcttaacactgatgatagctgtaagaccttccctaatatcctcaccggaaagattcggctcactgtcttttaataatttgttctttctcgcatagtcgttaaaggtctttgtgatcgcatttctgaatccgaccacatgggtcccaccttccggtgttgtgatattatttacaaaaccataggtgttatctgtataagaatcattgtgctgcattgcaacttcaacttctacattatcttttgttccttcacagtagataatctgctcgtaaagcggagtcttactgcgatttaagtactgaacgaactccttgataccgccttcatagtggaacactctttccttcggttcttcatcccggagatcagtcaggctgatgcgaagtcccttggtaaggaacgccatctcacggaatctctgttttaacgtatcataatcaaatactgtatcttcgaaaatagtttcatccggaaggaaggttacctttgttcctgtcttctccggatcacattcgtctacaaccttcagcttgtaaacaacatgtcctttttcatatctctgtctgtacaccttcccttcgtggcagatctcaacctcaagccagtcagaaagcgcatttacaacggaagctcctacaccgtgaagtccaccggataccttgtatcctccaccgccgaatttaccgccggcatgaagcacggtgaatacaacctctaccgcagggagtcccgctttgtggttgatccccaccggaataccacgtccgttatctataaccgtaattgaattatccggattgatgaacacctggatatgatcacaatatcctgcaagcgcttcatccaccgagttgtcaacgatctcatagacaagatggtgaagtcctcttgaagatgtactgccaatatacataccaggtctctttcttactgcttccagcccctccagtatctggatttggtctgctccatattctgcactcatattgatcctcctaattctcttttgatacatgtccgttctgaacatggaatactttatttattgaaaatcgatgattgacaaactcgtcaagtcccgtacaggtgatcagagtctgtatatcatgaatactgtccagtaaatagttttgcctgtgtttgtcaagttcagacaatacatcgtcaagcagcagcaccggcgtatcctttatgatctgccgtaccagctcgatctcagacagtttcagcgaaagtgccgctgtcctctgctgcccctgcgatccgaatctgcggatgtcgatcccacctgccataaaacagatatcatcccggtgaggtcccaccgaggtactcttcatcctgatatcgcgctccctgttcttctcaagcgccgcctcaagtgaaagcgctccgcatccaggttcatacgaaaggccgatcctttccctgcctcccgtcagtttatggtgaatgtctccgattatcgcattgacctcctcgataaaccggagccttctctgaataatcttttctccatactgaaccagctgcatatcccatacatccagtgtgtccagtatatcatctctgtaataggcatccttcagcagacggttccgctgattgagtgtgcggttataatttgccaggtcactaagatacaccttatcaagctgtgaaagctccaggtccatgaaccttctcctctccgccggaccatttttaataatgttcagatcctccggcgagaaaaacacaaaattcgtcagaccgaaaagctcactcgccctccggatcgggaccttgttaatcgcaatccctttcggactgttcttcttcaggtgcatatcaatctgccatggaacgccatttttctcaatgacagtctcaatatgagcctcatcctgcccgaatcggatcagatcccggtccttcgtccccctgtgagacttcgtggttcccgacaaatacaccccttccaggatattcgtcttgccctgcgcattatcaccgtaaaaaatattcgtggcatgatcaaattcaatattcaatatttcataatttctgtaatcttttaattttaatgatttgataatcatacctgtgccagcctatttttcaatcttgatctcttctccgttaaatgtaacaacgtcgccgtcatataattttttaccacgtctggtatctacttctccattaacctttaccagaccttctgtaatgacttccttggcttccacaccggatcctacaagacctgctgctttcagtgcctgaccaagcttgataaattcatctctgagtttgattgtctccataatttttgtcctctctaaattcctatactgctccactgaagttcaccggaagaatcaggtatacatagctttctccttcatccttgataaagcaaggagcctttgcattcataaagtaaagatctgcttcttcatcatcaatgacacgaagtgcatcaatgaggaacttcggattgaagccgatcaagaggtcttttccctctttagtgatcataatctcttcatccatcgtacccttctcggacttgatcttaagttccatcatttcatcctgaatgttgatgatgatcggcttcttatcaccttcttttacaagaagagttgcacggtcaatacagttcaggagttctcttttattgattcttacctttgtctcataatcattggacagcatctgctcgatacggaaatattctccttcaatcagtctggataccacaacggtatcatcaaattcaaatacaatgtggttggctgtgaaatacagtctcacttcgctgtctgcttcacctgaaaggatcttgctgacttcgatcagggtctttcccggaaccacgatcttcttcggttcataagattccttcagctcgatcttgcggatggaaatacggtgtccgtcaagggataccactttcagaatatccccgttcatatcgaagagttctcccgtcatcagtttgttgctgtcgttgtctgcaattgagaaaatggtctggcggatcacttctttcagtgtgaactgggaaatggaaaccggattttctctttcaatatacggcagataagaaaaatcttcaccggatttaccggaaatattgaattttgctttttcacaggtaatgagcgtctgaaagttcactccactttcaatcacgatttcattatcaggaagctttcttacgatatctgagaaaatcctcgcatccagtgcgatcattcccttctcatcgatctgccctctgatcacagtctcgatcccaagctccatatcgttcgctgtaagtttgataatatctgtagttgcatctatcagaatgcattccaggatcggcatggttgtctttgtcggaacagcctttgatacaatgctgacccctttcacaagatctgatttaagacatctgattttcataatgtgtaaaactcctttcgacgcgcaaaatatatatttatataaaacaaatccgtagttatcttagtagtgtctgttgaattgtggacaagtactttaaggccttgatccaaaaggatttaaggctttgacaagtccgtggacagttctttttcttccctggcagatcatggaaaacttttctacagcgggctgattttcttctgaatgatctcgatcgtatttctcaaagtctcatctttttccacatcccgggcaatcttgtccacaccgtggttcacagtggaatggtcacgccctccgagcagatcaccgatactttgaagagacgcatccgtcatctgcctgcacaggtacatcacgatttgtctggctccggccgttcttgcatttctccgacttcccttaagttcagagacggaaacattaaaatgatcggagacaacatccagaaccagctccggcgtcaccttgtggctatcgtccggtgcgatcatatccttcagtgcctctgccgccagagaaacatcaaagttctttcttccaccgatccggtataatgcaatcagcttgttaagtgagccttccagttcccggatattggtcttgatgttcatcgcaatatactggatcacctcatccggaatctgatatctttccagttggtccagttctatttttttataaagaatcgccatacgtgtctcgtaatccggcaccgaaatatctgcgatcagtccccattcgaatcttgtccgcagacgcgcctccagtgtcgtcatatcctttggcggtttgtcgctggaaatgacgatctgctttccggcattgtgcagatgattgaacgtatggaaaaattcttcctgtgtactttctttgccgataatgaactgtacgtcatcgatcagaagtacgtcattattgcggtacttatcgcggaatgcattcatcgccagatcgttgccggtctttccgttgcggatcgccgtgatcaggtcattggtaaatgtctcacttgtcacatacaggactttcttcgatggttcccggtccagtatgtagtgtgcgatcgaatgcatcagatgggtcttgccaagtcctaccccaccatataaaaacagaggattgtaaacctcaccgggagattcggcaactgccagtgatgcggcatgtgcaaaattattattccctcctaccacaaaggtatcaaacgtatacttcggattcagattcgctttttcagctatcgggcttacctctttatgcttatgtgtcttctcttttacgggcgcagtcttctccagatatctgcgctgctgctcgcgcggcagatctctgggaataaacttaatctgatactctgtcccggtaacttccgcgatgcatactttaagcggaagaagatatttattctgaatgtgttcgatgctcgccttaaaattaacggtaagatacagagtgttgcctctgatctcatatacctccagcgggcgtatccacgtttcaaaagaaatgttcgatagaaaatattctactttcagcttttgaatgatctcttcccatttttcttttatgacgtccatattcctgccccattcatcttcaaaataagcataatcatactcttatattctaccttaaaacgatttcagaatcaatcaaaaaccataaacttattcataatttccttaaaataagggtcgaaactttattaaaactgcttgacggagacagcttttttgattataatgaagtacgatgtcttaaaaacgtaaataagcttctattcatataagaaggaatcgataggaggtggatatcaatgaagatgacattccagccaaagaaacgttccagagcgaaagttcatggattcagagcaagaatggccacagcaggtggaagaaaagttcttgcagcaagaagagcaaagggaagaaaagtattatcagcataggtcacatatatgtggccttttcttctatgcaaatttatgtaaatcgggagaataaagtatgaaattttccgaatcattgaagaaaaacagggatttccagtctgtatacagaaagggaaaaccttatggcaacaagtaccttgtaatgtatctcctggcgaatgatctcggacgcaaccgcgtcggaatttccgtcagcaaaaaagttgggaacagcatcataagacatcatttaacaaggctgatccgtgagagttacaggttacacgaagaacagttccaatgtggatatgatatcgtgatcatcgcaaggacgaccgccaaagaccggtcataccatgagattgaaagcgctctcatccatctgggcaaacttcatcacatttattcggactgcaattagccagttcagtatatcgagaagacggatatacactacgaggcactgaaattatgaaaaagatattattatatttgattcgtttttacagaaaatatttatcacctatgaaggtatatacccactgtatttacattccaacctgctcagaatatgctttggaggccattgaaaaatacggtgcgtttaaaggaggccttctgaccgtatggagaatcctcagatgcaatccattcgccaaaggtggatatgatccggtgccttaaacctataggccgtccaaataccgggacggaaatgtttatggaggaaaggttatgacaggaattttaatgacacaggtcagcacaccaatcatcggacaggctgcctggctgctcggtaagatcatggatggtatttaccgggtaatggatttaatcggcattcacaacctgggtgtatgtattattcttttgacaattgtcatctacactttactgatgccgctcaccatcaagcaacagaaattttccaagatgtccgctgcaatgaaccctgagctccagaaggttcagcagaagtacaaaggaaaaaatgatcaggcttccatgcagaagatgcaggaagaaacacaattggtttatgaaaaatacggagtatcaccgaccggcggatgcttaagtatgtttatccagttcccaattctctgggcaatgtactatgtaatccgcaacatccctgcttatgttgggcaggttaaagcggtatacacaccgcttcttacctctatcatggcacaggatggatggcagaaggtcatggaaaagatcggcgaagcaaaaccgatccttatgtccgcctccaaatatgattactctgataaaaacgtactgatcgacgtactgtacaaattccagacttcaacctgggaaactctcggcaagaagcttccggatctgcagtctacgatcgacagcaccgtcgatacattaaagtccatgaataacttccttggacttaacattgcggaaactcctatgaacctcattagcaacggtgtaaaagccggcgcatggggaattgtgatcatggcagtgctgattcctgtcctttcaggactttcccagtacctgagcgtgaagctttctcagcagacaactgcagttacgaacaatccgcaggctgaccagatggcttcaaccatgaagacaatgaacgttacccttcctcttgtatctgtatttatgtgtttcacattacctacaggtcttggaatctactgggttgcaagtgccgttgtccgtatggtacagcagttctttatcaacaaacatctgaataagattccgatggatgaactgatcaaagagaatatggaaaaagccgctgaaaaacgcaagaacaaaaacgaagtggatgcaagcaatgtaaacaaaatggctcataagaacgtgaaaaacattcatgagccggtaagaacagctgctcagacaaaagaacttgaagaaaagcttgaagaagccaagaagaaaaatgacaatgcaaaggcaggaagccttgcagacaaagcaaaccttgtaaagcgctttaacgaaggccagaaatagggggacaagtcaaatgaatgagattacagtatcagcaaaaactttagacgatgccatcacagaagcttctatccagcttggcgtagcaagtgatcagatggaatatgacgtaattgaaaaaggaagtgcaggcttcctcggaatcggaagccgtcaggcagttatccgtgcccgtatcaaaaaaactgtaacagaagaaatcaaagccgaagaaatcaaaccggaagagatcaaaaaagaattcaagaaggatttccgaaaagaccgcaaggaattcgttggacacaaagaacgtaaagagtacaaagaacacaaagaatacaaaaaagattcgaaaaaggacttcaaaaaagagcctaagaaagaatttgtaaaagaaaacaaaacagaaacagcctctgccgtaacagcagcagctccggtttatgaagaaaagaaagaacttcatgtagccgttgtaacagaagcgacacagaagatctgtgagaaattcttacaggaagttcttcaggcaatgggaatgggcgaagtaactatcgtatcctccattgatgaagaaggtgctcttgcaattgagatgagcggtgacaacatgggtatcctgatcggtaagcgtggacagacattggattctctccagtacctcaccaaccgtgtagccaacaagtcacaggatggttatgtacgtgtcaaactcgacacagaagactaccgcaagagaagaaaacagactcttgaaaatctcgcaaagaatatcgcttacaaagtaaaacgaagcagaaagccgatctcactggagccgatgaatccttatgaaagaagaatcatccattccgctctgcaggctgatgacagagtttctacccacagcgagggcgaagaaccatacagacgtgttgttgtaacaccgaaccgccgttaaacagtaacgcaaattggttgcatacaccgttataactgaatcgttcacagtaaaccgcagtcatttaatggctgcggtttttttactgttcactcccgtgtcaatcactacgctgattggcacggaggatgcacgttttatcttgaatggcatctcgcccatcgccaaaggcgatttaaaatggcgagatgcattgctggtcacaggtactgtgaacagtaacacggtttttttctactcttcacaataggcacttccattttgacagctttcggggtaaaatgataacatcgcatttattacaaaagtatagaaggaagcaataaaatgggatttaaaacagacacaatcgcagcaatctccacagcaatgactaattccggaatcggaatcgtgcgtctcagcggagaagatgcgttttctattattgacaaaatttacaaaggcaaaagaccgaagcttctgtccgaacaaaaaagccataccattcactatggctatatcatggacggagagcagacgattgatgaagtgctggttcttttaatgcgtgggccgcacagctacaccggtgaagatactgtggaaatcgactgtcacggcggtgtatttgtcacaagaaagatacttgaaaccgtgatcaaatacggtgcaagacctgctgaaccgggtgaattttccaaaagggcttttctgaacggccgaatggatctgtcacaggccgaagccgtgatcgatatcatcagctccaagaatgactatgcactacaaagctcggtaaaccagttgaaaggctctgtccacaataagattaaagaaatccgtgaagtaatcctttaccataccgcttttatcgaaagtgcactggatgatccagagcatatcagcgtagacggatatggtgacagtctcctgggcgtcgtaaaggatctgcagcagaaaatccagtgtcttctggatactgccgatgacggacgtatcatcaaagaaggcatcaagacggttatcgtcgggaaaccgaacgccgggaaatcctctctgatgaacgttctggtaggcgaagaaaaggcaatcgtaaccgagattgccggaaccacaagagatgttctggaggaaaatatccagcttcagggcgtttctttaaacatcatggataccgccggaatccgcgatacctctgatatcgtagagaagatcggtgtggataaagcaaaagaaaatgcagaaaaagccgatctgatcatctatgtggtcgatgcatccagacctcttgatgaaaatgatcacgagatcatcgagatgatccgggataagaaagctgtgatactactgaataagagtgacttatccacagttgttgataaaaaggcattagaaacgttgataactaagccaatgatcgatatttccgcaaaagaggagaccgggatccatgaactggaatctactttaaaagagatgttttatcacggtgatatctcatttaacgatgaggtttatatcaccaatatccggcacaaaacagctcttgccgatgcactttccagcctgaaaaaggtagaagagagcatcgaaaaccagatgccggaagactttttcacaattgacttaatggatgcatatgaatctctgggaagcattaccggagagacgataggagaagatttagtaaatgaaatattcagcaaattctgtatgggaaaataaagacgcatacgacatcgttgtagttggtgcgggacatgccggctgcgaagctgcccttgcctgcgcaagactcggtctgaaaacgattgttttcaccgtaagtgtagaaagtatcgccatgatgccatgcaacccgaatatcggcggtacctcaaaggggcacctggtacgtgagctggatgcgctcggcggtgaaatgggaaagaacatcgacaagacatttattcagtcaaagatgctgaataaatctaaagggcctgccgttcattccctgcgcgcccaggcagataagaacaaatacagcaataccatgcgacagacactggaaaaccaggataacctggagatccggcaaggtgaagtcgtcaatatccttgtggaagatggttctgtaacgggcgttcagacctattctggcgctatataccgctgcaaggccgttgtactgtgtaccggaacctacctgaaggcaagatgcatttacggtgatgtcagcacgcataccggtccaaacgggctgcaggcagcaaattatctgaccgactgtctgaaggagcttggtattaagatgtaccgcttcaaaaccggtacaccggcacgtatcgacaagcgcagcattgatttcagcaaaatggaagagcaattcggcgacgagagggtcgtacctttttcgttcacaacggatccagaagatgtgcagattgagcaggcttcctgctggcttacctataccaatcctacaacccatgagatcatccgcaaaaacctggatcgttccccactttattccggtatgatcgaaggcaccggaccacgctattgtccgtctattgaggacaaaattgtaaaatttgccgataaagaacggcatcaggtgttcattgaaccagaaggtctggaaaccaatgaaatgtacatcggcggaatgtcaagttcacttccagaggatgttcaatatgaaatgtacagaagcgtgcctggtcttgaacacgcaaaaatagttaaaaatgcttacgcaattgaatatgactgtatcgatgcaagacagcttcatccgacacttgagttcaaatccattcatggtttgttcagcggtggtcagttcaacggaagttcgggatatgaagaagcagccgctcagggacttattgccggaatcaatgccgcactggaggttcttggaagagaacagttaattttagaccgttcccaggcttatatcggtgttctgatcgatgatctggttacaaaagaaagccacgaaccatatcgtatgatgacttcacgtgccgaataccggttactcctgcgccaggacaacgccgatcagagactaaccgaaatagggcacaaaatagggcttatttcagacgagagataccagatgttgttagacaaagaagaaatcatccgcaaggagatccacaggctcgagcataccaacgttggaacttcccaggaaatcacggattttctcacaaattgcggcagtacgcctcttacttcaggatctacacttgctgagcttattaagcgtcctgagctgaattatgagcttctcgaacctatcgaccatatgcgaacagaaagcttcagccgagagattatggaacaaattgatatcaacatcaaatatgaaggctatatcaaacgccagttaaaacaggtagaacagtttaaaaagcttgaaaccaggaaaataccggcagatatcgattacgatgctgttccgagcctgcgaatcgaagctgtgcagaaattaaagcagttccgaccgctttccatcggtcaggcatcccgtatttccggtgtctcacctgccgatatttctgtattactggtatatctaggacattagaccgccagataaccagacctgtattttgatcttttttgggatattacagaatccattatttctggtttctgtttttccctttatatagatgtgtacttttgagggcatcacccaaaaagtacacatctattttcaaagaaatggttttatcgtgtactttatagggcaaaaagtatgttttttcatcttttcgtataccttttaggtgcatgattgtatttctttaaaaacattatcactttatcgtgtacctttaaggtgctatcttctcagaaattgtgtacctatttggtgcaaaacagtgtaaattactgtttattttccgtaaagatgtgtacttttaggggaaaaaggagcaatatgagtaaaaaatttgagcaacagcttgcagaattaggtatcacattaacgcagacccagtttaatcagtttgataaatattacgaaatgctggtggaatggaacaaggttatgaatctcaccggtatcaccgagtacgaagaagtaaacgaaaaacattttgtcgacagccttgcattagtaaaggctctggatatcagtaaagttcaaaccgtgatcgatataggaacaggcgccggattccccggaattcctttaaaaatcgcctttccgcacctgaaaatcacgttgcttgactctttaaataagagaatccgtttccttgacagtgtgattgaagagttaaatcttacggatatccatacaatccacggcagagcagaagattttgcccgtcaggcagactacagggaacagtttgacctctgtgtttcacgtgcagtggccaatttatctacattatccgaatactgcctcccttatgtaaaagttggtggattctttgtttcttacaaatccggtgatattgtcgatgaactttccgctgcaaaaaccgcagtacatgtccttggaggtacacaaaataaaccagttgtattccagcttccaggcagtgatatcagccgttcatttgtaaagatcaaaaaaatcaagcccaccgggaagaagtttcctcgaaaagcaggacttccttccaaagaacctattcacggataaacagctatacatgcctgtagtctgtatatgccgcaatggaaattgaactatttttctttaccttgaacttctgctattagttctttttataatagttcaattttaattgttatagtttattctgttttgtatttttgatagttcaatttttgtatgctttgaaaatgtatttttatttttttgtatgcagttctgccagaaatttgttttcctatttcatttcaaaaagcgggtaagttcaattttttacccgcttaaaatctgattttttattttcatttagcttgattatttctgcaaaaagcccaataatcatccttctgttttgtttttcagagaaagacaatttccatagaaattcccagagttgcatgtcggttttcatggtgttcatgagtagaataagtaccagttaagtaccagttctgtttgctattagataatcgcaaaagttgatcaagagccatatatagccaaatgcgggatgtacatttcggtgtacatcccgcatttggctataatgtgtacctgaacgtactttatattattcagcagagaaaaggatatccagctgttctgcgaatccttccggttgttcaatttgtggaagatgtctcgtatcctttatgcacatacattctatagcaggtacatgcttctgatattgtttagcaatctcaatactgttttcatcatattgtccagagataatgcagatactatttgtcgccttgcgaatacaatgataaatatttgtctttgtatatccacctttgatgcttgcaaacaaatattttgaatgtgcgttttcattatgagcagattcatggtatatcttcgtcatctgataatctatcgcatcttcgtcatacagatacttatccacaaatttttcatcaattgcttctcttgaatgaataatgttgtacagcagcgtaccaataatcggtatttcgataaggaacttcagcgtcttggttctcttattcggacattttgcaagttccgtaagtgacagtggattcaccatacaaatctttccaatcacgttttcatcatttccgcatgccataactgcaatagcagccgattctcccgtagccacaacatctgccttttcgccaatgatatgtttaataaaatccgtcagcatttgcacataaaggaaattagtataagtaatatttggtttttcagatcgtccacagcctagcagatccacggtataaacagtatgcttttctgcaagaattgccgctacttttttccattctacgccagagctttctgcatccaaatcatgaagtagcagtagtggtttaccatttccctgttttctataatagatttttccaaatctccagtcataataatttccctctgatgagtttaacaagctgtcttttgttgccatttctataagtgttttatttatcagatggattgtaatcgcaccaagtgttgctaaaatcgcacaacttttcaatttatttttcatcgttaattgtcctttctccgaatcatttttgccccgattcagcaagatcatactcgcaaatagtatctgttttgtgtaatttttcaccttgcggcttatagataagtataccataatctccttacagtttaaagattttcatcatgttattgttccttggttttcgacaaaatgtttcacgtgaaacattttgttttctcttttttccagctgctcatagccaaatatattttaatatatccaaaatatgatgataccatgggcaaaaggtcagaaagtcgatgtaagcttgcttgtaagaggatttttgacctcttgaaccgcaaaagaatgagtaagtagccattttttcaaggaaaaatgagcggattacgaatgtttttatacattttcacatttcactttgtgtagaatgtttcgtgcaaaaaatccccttatttataaaaaatgccaaaataaatgtttcacgtgaaacatttagtagatttagataaagtttagtgttacaattatacctagatgtaaataaaacttcatatatatttgcacactattagaaaggaggtaattgcaatgggacgaataattgccgttgccaaccaaaagggtggcgttggaaaaactacaacagcgatcaatttatcctcgtgtttatcggcaaaagggcagaaagttctcgcaatcgacatggatccacagggaaatatgtccagcggtcttggtatagataaggataatgttgcctatactgtatatgatcttttaatcggcgaagccactatggatcaggtgttatgcaaagaagcaattgaaaatctcgacgtaattcccgcaaacattgatctgtctggtgccgaaatagagttgctcgatactgagaacaaagaatacatattaagagatgaggtgcttaagataagaagtaattacgattacgtcattatcgactgcccaccttcacttagtatgctgacaatcaattcaatgactacagccgataccgtattggttccaattcagtgtgaatactatgcacttgaaggattgagccagctgattaaaacaatcgagcttgtaaaagaaagattgaacgaaaaccttgaaatggaaggcgttgtatttaccatgtatgatgccagaaccaatctttctcttcaagttgttgaaaatgtaaaagataatcttgatcagacaatttacaaaactatcattccacgtaatatacgacttgcagaagccccaagtcatggcttaccaatcaacttatatgatcctcgttcaacaggagctgaaagttatatgttattagcagatgaagtaattcataaaggagaagagtaagcatgacagcaaaacgaggcggacttggaaaaggtcttgatagtttaatcaaagaaaacaaaactgcgaaacatactgcaccagttaaaaaagaagtagtgaatgctggaccaattatgatgaagatcaatgatgtggagccaaaccgtgaccagccgagaaaacattttgaggaagatgctctcttggaacttgccgattcaatcaaacagtttggaatcctacaacctctgattgttcagaaacggaacgattactacgaaatcatcgccggcgagcgtcgctggcgtgcagcaaagcaggccggtatcaaagagattcctgttatcattaaagaatacacagatcaggaaatcgttgagatttctcttattgaaaatattcagcgcgaaaatctgaatccaatcgaagaagcgcaggcatacaaacgcttgctaaatgaattccgtctgaagcaggatgaggtagctgagcgcgtttcaaagagcagaactgctgttacaaactctatgcgtcttctaaagctggacgagagagtacagcagatgatcatcgatgacatgatttcaaccggacatgcacgtgctcttcttgcaatcgaggataaagagcaacaatatattcttgccaataaagtatttgatgaaaagctcagtgtccgggataccgaaaaacttgtcaaagaactaaagacgcccaaaaaagaaaaagaaaagcctgttatccagaatgcatttgtatatgaagatctggaggaacgtataaagtcaatcatcggttccaaagtccatgtcaatcataaagcaaatggaaaaggtaaaattgaaattgaatattattcggacaacgatctggaacgtatatttgaattgttaatgtcaatacaggaaggaaaataatatatggaaagtaaaattctaaagtcacttggaattgatccggcgtatatatttctttttcttatcatgctgatcatattgatgtttcttctttatattaatgttaatatgaaatacaaccgtctgaaatcaagctataacgtattcatgcgcggacaggacggtaaaacgctcgaagaaagcttcagcgcaagattcgatgaactcgacgagctttccaacattgcccacgaaaacaaagcggacatccgcatattgtatcgcgcgttgcgaagcagctaccagaaagtaggtattgtaaaatacgatgctttcggtgaaatgggtggaaaactcagcttcgccctcacaatgcttgacaatgataacaatggatggatcctcaattccatgcacagcagagatggctgttacacttatataaaagaaattgtgcgtggtgaaagttacattgagctctctgaagaagaggccgaatcactagatcaggccgtttaccaggaaatgtatgatccggatgtacaggatgcgatcaaaccacagtaataaaaataaagaaataagacaggagaacagttatgttagatattaaatttttaagacagaacccagatgttgtaaaagaaaacatcaagaaaaaattccaggatgaaaagcttccacttgtagatgaagtaatcgaacttgacaagagaaaccgtgaaatcaaaggcgaagtagaagcactccgtgctgagaaaaataaagtttccaaagaaatcggtgcatgcatggctcatggcgaaaaagagaaagcagaagagcttaagaaaaaagttcaggaaaacgctgcccgtatggaagaactttctgccgaagaaaaagaagttgaagcaaaaatcaaaaaagatatgatggttatcccaaatatcatcgatccatctgtaccgatcggtaaagacgacagccagaatgttgaaattgaaaaatttggcgaaccggttgttccggactttgaaatcccataccatacagaaattatggaaaaattcaacggaatcgatcttgaaagtgcaggaaaggttgccggaaatggtttctattatctgatgggagatattgcacgtcttcactcagcagttatctcttatgcacgtgactttatgatcgatcgtggattcacatactgtatcccacctttcatgatcagaagcaacgttgttacaggtgttatgagctttgccgaaatggattctatgatgtacaaaattgaaggcgaagacttatatctgatcggaacaagcgagcattctatgatcggtaaattcatcgataccatgcttgatgaagctgaacttccaaagacactgacttcttattctccatgcttccgtaaagaaaaaggagctcatggaatcgaagaacgtggtgtatacagaatccatcagtttgaaaaacaggaaatgatcgttgtatgcaaaccagaagaaagcaaagaatggtatgataaattatggaaaaacactgttgatctgttccgttctcttgatatcccggttcgtacactggaatgctgttcaggtgaccttgccgaccttaaagtaaaatcttgtgacgtagaggcatggtctccaagacagaagaaatactttgaagtaggaagctgttctaaccttggtgatgcacaggcaagacgtcttggcatccgtgtaaaaggaagtgacggaaacaaatatttcgcacacacactgaacaacacagtagtagctcctccgagaatgctgatcgcatttctcgagaacaatcttcaggcagacggttctgtccgcattcctgaagtacttcgtccatacatgggcggtaagtctgaaatcagatagaaaacgaggtaaattttgcataaatatttaaacgctatcggattccacgatatcgcatctgaacgcgaatggtatcagattcttcttgaatccgaaaagaaattttccggatatgaccgtattgccctggacgagcacacagatctctgtgagcttcgcagggaatacggcaacgggattggcatttcttcctgcggctttatcgatgaaaatgatgaagagttccgcagagaatgctatttcccatatttttcaggcagtggagtcagctcttatgctgatattgcagtagaacagaaagcatcctcaccgacctatattggtgtctgcgaagatgtaaagctcggctgcagtatcattttccatatccagaacggaatggaatacataaaagaagccactctcggtggtctgagcaaaagttcaatctctataaccttttctggtcttgccttaagtgggaaaattttgcttccggtcacaaaggatgcaggtgctgcggacaagagagcgaaagatctccgcaaccggatgatgcttatgagcgcagcaaaggaagggaatcccgatgccattgaaagccttacgcttgacgacatcgacacctatgccgcagtatcgaaaagaattcgcggggaagatatttacagtattgtcgatacgcattttatgccagctggtcttgaatgtgaccagtatgcgatccttggtgagattctgaatatcgataccatcgaaaatcttcttaccgggaaaaaactttatgttcttacagttgaaaccaatgagcttcaatttgatgtatgcgtaccggttgaaaaggtgattggcgaaccggcagttggaagacggctgaaggcacagatctggctgcaggggcatattaatttttaggaaagatttttgacttatataaaaagcatgaccaaatttcttttaattgaaaattagtcgtgcttttttgtatatgcgtttcagaacattcggctttacataaaaaagtcctgtaaaagctatttcacatatcagatcccgctctgttacctcaccatgatcatcctcttagaaaagcatttgacattttcatgttcaaacggtatgatatatgtatatgttctattagtcaaatgaatataagaatcgtctcctaagagaaagccgagacattccccaaagggaaaaaatgaaaaacaactttcagttcgaatctattctgaaaaatgccaaaggtgacaacaaagcattccctaaattggggaacgttctaatgttaccaaatcaaaaaaatctgtagattgacaactcgaaaaagagttgataatcttatatatggccgaagggaaaaatcccagaaacccagtaaaatcaagggtttacggcatgtgtcgtcatagctcagctggatagagcactcgcctcctaagagaaagccgaggcattccccaaagggaaaaaatgaaaaacaactttcagttcgaatctattctgaaaaatgccaaaggtgacaacaaagcattccccaaattggggaacgttctaatgttaccaaagtaaaaaaatctgtagattgacaactcgaaaaagagttgataatcttatatatggccgaagagaaaaatcccagaaacccagtaaaatcaagggtttgcggcatgtgtcgtcatagctcagctggatagagcactcgcctcctaagcgaggggtcggaggttcaaatcctcttggcgacgggcttcaaagcgttcgaaaatgttagctggattagctgacagcgaacgcttttcttattttctaatcacgttcgtggcatgaaattccattcaaaatgatccatttccagctaacacaatccgatttttgttagctgacagctaatcaaaatcaccggtttgcaaacatggtttttcaagagtccagctaacatttgggttccgctctgttgtcaccccttatttggggatgtaaatcagagaaaaggcaggaaaagaaacaatctctccgaaacctgcaaacataaattagatgaaacagtattcaattctattagctacagctaatagtcaaacggcaatgtctgtttggaacttttcttacaacaaaagttccaggcaggcattttttatttcctgaatcctggaggaaaggagtcaagatgactgatgcaaacagacaatcaggagaaaaagaagaaagaatcatagaaattgagattgaacgtctccgcccttttaaggagcatccgtttcaggtgaaagatgataaggaaatgtttcttctgcaggaaagcattgagaaatatggaatcttaaatccgctgatcgtcagaccggtaccggatggctactatgaaatcatatccggtcacagaagaaaacatgctgcagagaaacttggataccgtaaagtaccggtgatcatccgggtattaagtgaagatgattccatcttaagcatggtggattcgaatcttcatagagaacggatcagctacagtgaaaaggcttttgcttacaaattaaagaatgacgtattgaaaagaaaaagtggtcgaaaaaagagccaaattgaccacaaaaaaacaagaaaacgttcgatagatattatcagtgaggattgtggtgatagcccaaaacaagtgcagcgttatatttcactgacaaagctgataccagaaatgttgcagaagctggatgatgaaattatttctttttgcccggctgtggaaatagcagcactgaaagaaaatgaacaaagagaactgcttaaagcaatggattatgcacaggcgattccgtcactctcacaggctcagcggataaagcagctgagtaaagaaaaacagttatcgctggaaaagatggaagaaatcatgtgtgaagttaaaaagggtgagatcacaagagtggcattcacaaacgagcagttacacaagtattttccaaattcctatacaccggcaatgatgaaacgggaaatactggcactgctgaaattatggaaaaaagaatcatgggaaagttaaaggaggaagaaatcatgtgtaaagttatatccgtagtaaaccagaaaggtggagtcggcaagaccaccacaaccgtaaatgtaggtattggactggcaagagaaggtaaaaaagtactgttgattgatgcagatccgcaggggagtttaacagcaagtcttggatatgaagaaccggatgatcttcgaattacactggcaacaatgatgatggatgttatcaatgaagaagatattaatctggaagatggtatcttacatcatcaggaaaatgtagatctgcttccagcaaatattgagctttccgcactggaagtaacgatgggaaatgttatgagcagagaaatgatcatgaaagaatatatcgatgcgataagatcccgatacgattatatcctgatcgactgtatgccaagtcttggtatgatgacaatcaatgcactggtttcttccgattccgtgctgatacctgtacaggccgcatatctgcctgttaaaggacttcaacagctgattaagaccattcttacagtaaagaaaagattgaatcggaaactggcgattgagggcattctcctgactatggtagatttcagaaccaattacgcaagggacattgcatcaagagtacatacaacctacggaagtcagattgaggtatttgaaaatgtgatcccgatgtctgtaaaagctgctgagaccagtgcggaaggaaaaagtatctacatgtactgcccgaagggaaaagttgctgaggcatatatgaatttaacacaggaggttttgaagaatgaaaaatagaagtggtgaaaagattaagctggcaagtattgatgaactgctcggtgtggtaaatgaagaatctgcaatggagatagagatcagtaagatccatccgtttaagaatcatccattcaaggtgttggatgatgaaaagatgcaggatctggtagagagcgtaaagatcaatggagtgttgacaccggtacttctccgtatggatgaaaacgaagattacgaaatggtatccggtcacagaagaatgcatgcagcacagcttgcaggactcacaactattccggcaatcgtaagagaattatcagatgatgatgccattgtggcgatggtggacgctaacattcagcgagaggaactgttaccgagtgagaaagcctttgcctacaagatgaaacttgatgcaatgaaaagacagggaatcagaacagatttaacttgtgtacaaaatgaacacaagtcaggtaaaaagtcacgagaattattgggtgagcaagttggaataagcagtgtacaggtgactcgttatatccgactgacagagcttattccggaacttcttgatctggtagataacaaaaagcttcagttcacggttgctgtagatatctcttacatcgataaggaagtacagggatggatttacgaatatatctgcgacacaggatttatcaaaccaaaacagattgcagcacttagaaatcagctgaatgatggaccaatcaatcagatccagatgttatcgattttcaataattgtgtaatggcaaagaaagtatcccggtctcttactttctcagaaaagaaactgacaaagtattttccggatgattatacagccaaagatatggaacaggtaattgaatcattattagaaaaatggatgcaggaacagtcctgttaaggatagaaaaagctaagaaaacaaagtcaaagaagtttaaaaagaggacttcttagcagaaaacgaaaggaggaaattatggagaaaaaaatgacatttaattatttttacggtaccgaagctgatcagttcagcttctaccgcataccaaaagcattatttacagacagctactttaaagatttatcaagcgatgccaaaattttatatggactgatgttggatcgaatgtctctttccatcaagaatcagtggtttgacgacaaaaacagagcatatatctacttttccatcgaagatatcatggaattactgaactgtggcagaaataaagccatcaaatccatgagagaactggatgacgaaacaggaattggtctgattgagaaacgtagacagggatttggaaaggtgaatgttatctacgtaaaaacctttatgcctgagaaaacagatgagaaaaaatttggagaggaattagagaagtttaaaaaacaaacttctgtggaaaatgaagagactgcagaagtttacaatttaaacttcatgaagtcccaaaatcaaacttctagaagtcccgaaaacaaacttcaagaagtttacatttcaaaccctaataatactaatcttagtgatactgaaatgaatgataataaatctaatcatatcatatctgtggatgagaaaagatgtgatagcgataatcgctctgaggattatcaggcttatgaaaaccttgtcaaggagaccattgattatgaatcactggaaataacccatcatgacgatatgcgacaggtagatgaagtcgtgaacctgatcgtagaaactgtgatgtgtaaaaatgacaagatcttgattgccagcaactggtatccggcatctctggtgaagaaaaaatttctgatgctgacctattcacatatcgagtatgtcttacactgtatgcgtggtaacaccacaaaggtgaagaacatcaagaaatatttattagcagccctgtttaatgcaccgtctacgatgaatgggtattatcaggcagaagtgaaccatgatatgccaggactggtaagataggaggtgcacatgtttattttaaaacttgctgggaagatattattactgccggtatggctgatactttttgtgatcggcctggcagtgaagatgacagtacagacttatgcggttgtcagaggaatccttggatttatattcactttgttgattatagcgactgcatactgttaccatgattgggtacaggttgcattcctgttttcgctgagtgtaattctgtatctgatcctgtttgcaggagtgtttatagacactgtactggatatgacaagagaaagtattattgattttattttatcgtgaggaggatatgaaaatgagcgaaaacaatgattttattcagttaccaccgatcaaaaaagacacaccttccgaagtggtctcaatgatctggcaatatttgaaattacccgaggaatccagaaaaagggtgaaagcagagttgattaatgtacatgagaactgtgggaaagaagattttcagattcctaatctctatgacatcgtttcaaaagaggaaatcgcagaatttgagggcatcatgcgtaagatcataacaggaattatttctgaggccagtggtatagccacctgggtgtatgtgcagaaatatgagaaacacaaaactctggatgaaatgctgcaagaatggcaaggcgcaggccagtttattattgtcatggatacctggttcgaaaaattgatggcggaataatatgatactgtgatagaatgaagaaaacgatttgatgtgcaaatcggaatttgtggagagatttcctgaactttccttattttacaggcttttcagcccattaaatagtgaaatgatatgtattttcccttatttttgcccttatgcggaatccgcaagggaaataagggaaatttttagttaagcattgctcgctactttatcaagaagtcttgcggaatcccgttttgcttttcttgttgagtgagcgtaaatattcattgtggtactgacatcagagtgtcctaacagttcctgtacatctttcggtgcagctccattggaaagcagattgctggtataagtgtgacgcaactggtgaaaatggaaatcttcaaatccttccagcttctttgccactgatctgcatacaatgctgagtgtactcggcagttccaaagagccatctggtcgcaggcagacaaaggagatttctttgtaatctgtcgggacttcctgtgttccgtcaagatgatagtattcataatataccctgtttttcacatgcacttctttgtagtaattgcggtgatataattcgccatactgcatccggtttttgagctgttcttttctggcagctttcagtatttcagtcagcgtatctccaaaatcaacaatccttacttttttccgtttcgttggtccgataatatttttgtgtttcatgccgtcgtagcggatactgcgttttatggtcaggcattgttcctcaaggttaatgtcctgccatgtaagaccacaggtttccccgatacggagcccggcataatacgcaatttgaatcggaagaatagcaggtggatttttcttttccagatattggataagccgttcataatcctcatgtgaaatcggctgtgtaccttcttccacttcatcatcggaaaagaggtcaacttcctctgcctgctttttcagcttaatatactgcatcggattgaaactgattaactgttttggaaatactgcaaaacggaatgactgctgtaacactgcggaaaaagaatggatataatctttgctgtatcccttttttactttcccgtctggaaactcaccaccgaatgtaagcagatcaagaaatgcctgtaaatgttcggcagtaactgttttcagtttgcggtctgcaatcgggtgttttttggtacatcggattgcaccaagataattttccactgtaccgttgctgagtgtcccagttttcagttcttcttctgcccacatatccagaagttcccctacggtaagattatctgcctttgcaacaaacttcttatcttcgtagtcttccagtgccttgcggagaagcttttccgtctcacttttactttcggttccggcgtattctttctgaaccattttaccgcttgcatcttctacatagaaacgatagtaccatttttttcctttttttctaacagatccttttgccataatcgtatgtctcctttcgatatcagacaatcggaactgctgaaatgcttcttgcgtgtaggcatcttatggacaagtccataagccaattcgccgctcgtcaaatctgtaaacagcttgactcgcttgcgctcattgtatcataactccgattatcttactataccgattcagaatcgtcatacataacttcggataaaagatttgcaagcctttgttctgccgcttccggtttctttgaatagagccttacaacatctgccatatcattaaatgcgttgacagtatgtgtgatctccctgagaaacataatctcattatattcatctttcgattcaaatcccattactttggcaatgtccgcatctttggtactgcctttgtaatttttacaggcgaactgaaacgaatccagaaacagttcatattgctttaacattaacagcagtaagtctttagaaaaagcgtcttctgttttattgaggtcaagaggaaactgtttgagaatgtcgcccatcgcatcacgaatctgcaattctttcttatccgtaatatcagtttcatattcatcggtttcccctttgagccattcaatcgatacatgaagtgcttccgaaagaccttccagtaccatctttttggtattgtcaatcgaaccattctcataacgcaggattgtggaagcggtaactcccatcttctctgcgacataaggctgtgtcagatttaattccagacggcgctgttttgccctgctgccgatcagcttgcgtagttctttatctttcatgctgatgtgcctcctttttcggtatgtcattactataccacgcaacaaaatatattgcaatatgcaattttaagaaaagcagcaaaatttcataatgcttgacaaagcaatataaacacgctatactgacagcacaaatgaaattgcataatgcaattcgaaaggaggtggtcatatgacgcaaagaaagattgccttatctattgaggaagctgctgattatacgggaattggcaggaacaccctgcgaaagttggtagagtggaagaaacttccggtattgaaggttgggagaaaagtcctgatcaaaacggatatgctggaactttttatggaagccaacgagggcagggacttgagggataagggaaatgtgaaagcagtcacaagaaacggttcaacttaaaaaagcggttcccgaagaaaccgccaaaggttctatcagaccggagtcatgatatacctacacgcaagcagattataccatgtacttcgtctgacagacaacaggaaacttatgtttggaaaaaaagaaaggacgatgatatttatggcaagatcaacaaagagttatgaggagcgtatgctccagttggaaaagaaagaacaggaaagccttgagaaagcaaaacagtatgcagcacagaaacgggaactgaagaaacgtcagaaagatgtggaaaccaaaaaacggacacacaggctctgccagattggcggtgcagtggaatcggtactgggttctgcgattgaggaagatgatatcccaaagctgatcggcttcttaaaaaggcaggaagcaaatgggaaattcttctcaaaggcaatgcagaaagagccagttgcaaatacggaggaagtgtaatgccggagggagtggagtttccattcccttcattgcttttttatgaagggcgcacttatggacaaccagaggtcgtccgtataagtttgccacaggtggcaaccggtctgcgcttacgcttgccgggctcgttccgtcggcggggctttcagccagacctgctcatgccgcaggaggcactcttcgccagaggggcacattccatgcaggctgttatgcacagggcactcttacgcagagggtgctccggcagataccattttcttttaggaaaaacgttacctgccggaaatcaaagccggatacggcagaatggaggaaacggagcatggcgatttttcattatacagtaaagattgttggacgcagcaaaggaaaatccatcatatcggcgtctgcttatctcaatggcgatgtgatgaaaaatgaagaaacaggcaggatcagctactatacttcaaaaaaagaagtcgtttataccagcctgctgatgtgtgaaaatgcaccacaggaatggcagaatgtacctgctgaaaatatcagacggttccagaaatctgtccgatataaaagggcagataaccaaaatgctgcactggaaaaattcaaacttacttttcagaagcagcgtttatggaatgaagtcttgaggatagaaaaaagttcagatgcacaactcggcaggtcatttgagttctcacttccgaaagaatggagccgacaggaacagattgattatacaactgaatatattcaaaagacctttgtagataagggaatgtgtgcggattggagtatccacgataaaggagatggtaatccccatgtgcatttactggtgacgatgcgaccattcaattcagaccactcatggggtaacaaagaaatcaaggattgggagtttgtcagagatgaaaatggaaatattgtggtggatgaatcccatccggactggtggcaggataaaaagaaccctgaccgtcatggaatccgaatccccgtacttgatgaaaatggagtccagaaagtcgggacaaggaaccgcaaacagtggaaacgtgtattaaccgatgctaccgggtggaacaatccgaaaaattgtgagctatggcggagcgaatgggcaaacgtctgtaatgcacatttgaaaacggaaaatcacattgaccatcgttcttatgcaaggcagggaaaattagagataccgacgatccatgagggcgcagatgccagaaaaattgacgagaaatttcaaaacggacagacatcctctacttcatggaaagtagaggaaaaccagatcataaaaagacaaaatgcactgctggataaaatacagatttcttttggaaaagtatccagtgcattaacacaatggaaggagcgattgcgtgacattagaagaaagccgggaagtcattcccatgatggagacaatgataaaccagatcgaggaacagcagaatcttatggcagagatggtacaggaattgcaggaacgggacaggcagctcctgtcttttcaggagcagaaccagagtttaaaaagcttaaacagcgaattatccaggctgctaaatcttttgccagatacagaagaactgctctcacagatcgagcaacagaaaaccagaatcgaacagttggaaaacgagaatcagcaatggcaggaattaacgcagaagctgaacaacgagaacagcttattgcagaaacagaacagcgaattgctgaccttaaacagcagatagagaaagcgagggagatcgatgagcgaatgcagaaacttagagaacgtcgggcaggtggaagaacttctgctgatgaccgaacagatgcaggacgaactggatcagaaagaccagacaatccaggaactaaacaggcagctaagcgaatcgctgaccttgaacgagaaattgaacagcgaaaacagagccgagaatatcgaagcattgcggacaagattaaggcaaacagaggaacgattgaccagcgagacagacagcaggaaaagagccgacgcagaagccgtggcatggaaatttaagtatgaaaaagcagagcaggaaaaactttatgcacagacacaccaaaagacggtagaggtagctgttgagaaaaaagtgccttatgagaaatgtgaaaaatgtgaccgtactgcttaccggaaagcaaaagaaaaatgcgatagccgtaaaagccagttagaaaagaaatataaaaatatgacgattggttatgaaagtatcttgtttctactggcatggtacagcataacaacaacactgtttactgcgattctttcgccggttttccttaacgactgtatcgtctttttcggtgcgttaggaaaaggaatgggaagtttatttcgggagtttgtgacaggtgcagactctttcggacagttaagcagtggaatacctaacagtattctttccgggattgtgtactggctgattgccggtactgtcatggcaattttattcgtaataaccgggtggctgataatcgggattggttatcaggtaggaaaaatctaccggaaatattgttgggatatcatcagtatcgtggtagcgataacgagtacagctgttgtaatttactttggagaatggattaaaaacgctaatccgataaatcttattgtattgctattactgtcgcatattatttatattggaatcagatgttatgtgaaagactggatggaagaacgaggatattattaaaagaggacagggaaatttcataatcttcctgtccttagtaagggactattgattgtttatataaagaaaaagtatataaataaatcttgacaattagtacgaactcggactataatacaaaagtccggattcgtactaatttaaggaggaaaaagatgagaaaagataataatatgataatacagttgcaacgatattatgctttatggaaagaatgtacagcaatgtatgaggaatggtcaaaggatcagggactgtcttcaaatggagtttttgctttgcattcattttatgaaagtaatggaagatgcacgcagaaaatgataagtgaaaaatggaatatacctaagcaaacggtaaatacgatactaaaagattttcagaaaaaaggatacatcaatatggtatctgatgattcagacaagagaaataagctgatatgcctcacagaatcaggaatggaatatacgaaagatatcatagaaaaactgcactcaaaagaaataaatgtaatcgaaaaaatgggattagagaatatagaaagtcttaatgataatacagagctgtttatcagacttttcaaggaaggagattgtaagaaaaatgaatcataaatcattattttttaaatatgttattccatctattatagcatttgcattatcaggaatatatgcgatagtggatggatattttgtaggcaataccataggagatgctggactttcggctattaatattgcatatccgattgaggctttgattcaggctcttggaacaggaattggtatgggaggagctgtttattactcaattaatgcagcagaaaagaaaggaaaacgggcagaagaatttattgctacaagctggtggcttcttgtaatagtaagtgttatcagtaccataattatttactccttttcgtctaaaattttaggattgcttggagcagatggaattatattaacaaatgcgacagattatatcaaaattatagcacttggagcaatattgcagattcttggaactggaatgatgccattcattagaaattatggaaactctttctggtcaatgtttgcgatggttggtggattcataaccaatattgttctggattttatctttgtatggatatatgaaatgggcatgaaaggtgcagccacagctacaatagccggacagggtgtgactgcagcaattgcaatcatatacgcattatataataaaaagttttatgtgtatgtatccttaaaaaatgtaaaagaaatgtgtggcgctatattcagagtaggtcttgcaccatttgggctagcattgactcctaatatttcattggtgtttataaaccgattctccgcttcttatgggggagaaaaagctattgcaacttatgcatgtgtatcctatattatctgtatcatatatctcatattgcagggcgtaggtgatggaagtcaacctttaatgagccgtttttatggtgagaaggatcaagaaagcctgagaggagttcagagaatggcatacatttttgcaataattcttgctgtttgtggtggaattatcatgtatgtaaacagagcaaatattggaggggttttcggagcttcttatgaagtaagtattgagatttctaaaattgtacctatatttttagtgtcattaccatttgttgcgattaccagaatagcgacagctggattttatgctactgaaaaaagtggattgtcatacattcttacattcattgaaccagtattgatgctgatatttatgcttgttttaccacctttatttggtggacagattatgatatggtggagtacggtattggcacgtgttttttcagcgattctggcattcatactaataaaatattgcgaaaagggagatttgcaatatggaatacagaaaatttaacaatcagatagtagcaagaataatctaggtttatctattgtatttttaaggacagcctcatagcaatagggctgtccttttaaaattatgaagctaatttttaataaattctagtagattttgattggaataatcataactctaatgaatcttcagcatctacccacatctgtaaattcccatcaagatataaccttgcatattctaatggctcatcgattgcaagcgatgtcaaagcacaatcagatccaggtgtggttcttaaatttttttctgcttcccaacaatcaatacggagtatatagcccgtattagtatatacatcaatgctgttgcactgtggattgtattctgcaaatattgttctcatcgtatcccatctccttatcatttaatcaatcagtagtagcaaaaattaagaagcatttcaatcagttcaccatgtcacttttattttgtgttatactgtcttatagatttttcttgcccttgtatttgcccttatcagagtgcataaacactgatgggacgatataacacaagggaaataataagggaaagctcacctgcgacaaatccagtgttttcaaggggttgcgaagaatttaataataaaatataacagttattaaatttcttaaaacaggtgaaatctcaatcggaatttataaaggagaatattgatgaaactatttttatgttcgcacttttcaagtgtgggaagtctgataaaggaagaaattgaaaataagaaagtcgcatttattccaacagcttcactgcgtgaaggctacaccggttatgtcggctcggctcgaaaattattcaaaaagttgggagcaatcgtaactgaaattgatatttcaacggaggcttattcaacgatacagtctgtttttgaagaagcagatgtgatatattttaccggcggaaattctttctttcttatggaccagctccgtaaaacgggaactgatgggctactgaaaaaggaattggcaaatggaaaattgatgatcggcgagtcggcaggcgcaattatatgcgctccaagcatccaatatatcgagcaaatggatgaaaagccagaggactactcacaagaagatgatgcagggcttgatttgattgatttctatgttcttccgcattatcttacagcaccatttaagaaagttaccgagaaaataatgactgagttttcggatttgaatctatgcccgattaacaaccgtcagggaattgtaattgatggtgaaggttcaaaggttatttgcaaagactaatttgaaaattcctgtttttgaaactggaaaatcggaagctgaggagatagactattgagaacatatgagaataaagacgagcttaaaaacgagataaataaaagctttggaaaatatatttcagaatttaatgatattccggagcatttaaaagataagagaattgatgagatcgatcgaactccggcagaaaatcttgcttatcaggttggctggacaactcttgttattaaatgggaatcagacgaaagaaagggtattcctgttaaaactccttcggataattttaagtggaatcagcttggcgaattatatcaatggttcacagatacatatgctcagctgtcactgcaagaattgaaagacagattgaatgagaatatcaactctatttatgcaatgattgattctctgagtgatgaagaattatttaaaccacatatgagaaaatgggctgacgaagcaactaaaacagctgtctgggaagtatacaaattcatacatgttaatacagttgctccgttcggaacctttagaaccaagattagaaaatggaaaaagattgcactataacttcaagtttacagaactgaatcaaaagagctcgaaggagctctttttccttttttataatagtatcattatggtataatagagacattaaaatcggtatttaacgaggaggtaatgattatgagtagaaatataaaaggtggttttttaacattaagtagtgttgttggtattgtaggaatgataatagcggcaatgcaaaatccagcaactgcatgggtaacgccacctggaagaatgattataagtattttagaaaatggattattgattcctacggttttattccttgttctttttatctatggattgtatattctcctaacggagaaaaacgattgagcaataccggtttgtcgaattaagaaaaccggtatttgtggaggaggaattctgtaatgagattttttgaaaatacccgtaagccacaaggcttcggcggaaagttgatgacgaagatgacgaacagcggtcacgccaaattatcgcaatggggattctcaaatatctccgcgaagtctgatgctgaagttctggacgtcggctgtggcggcggagcaaatattgcggtctggcttgatagatgtagaaatggccacgtgacaggaatggattattctgaggttagtgtggcggaatctcaaaaattgaacgccctcgccattaaacaagggaaatgtaatgtagttcaaggagatgtatctgctatacccttttctgatgcgacttttgattatgtttctgccttcgaaacagtttacttttggccaggattagtaaaatgcttttccgaggtcaaccgtgtgctgaaaagcgaaggtatattcctgatttgtaacgagagtgacggaacgaatgccacagatgaaaaatggacaaagatgatcaatggtatgaagatttacacatctaaacaacttgttgccgctttgaaagaagcgggttttacagagatcaaaacgtattcaaatgcaaaaaatcattggataagtattgttgcaacgaaatagccaaatttgaatttgtggaggataaactattgtggataaagcagttatttatatacatggaaaaggtggtaatgctgaagaagctattcattacaaaccgttctttagtaattgtgatgtgattggtctcgactatactgcacagtttccatgggaagcaaaagaagaatttccattactttttaattcaatttatagaaactacaagactgttgaagtaattgccaatagcattggagcgtattttgctatcaatgccttatcaaatcagcaaatagagaaagcatattttatttcgcccgttgtagatatggaaaggcttattgctgatatgatgatttgggcaaatgttacagaggatgaactcaaagagaaaaaagaaattcagacaacctttggagagactctttcatgggattatctttgctatgcaagagaaaatcctattatatgggaaatcccaacgcacattttgtatggtgaaaaagataatcttaccgcttatggaacgatatttgaatttgtacagaggactaattcaacactttctattatgaaaaatggagagcattggtttcatacggatgaacaaatgaaatttcttgatgaatggataataaaatcttccaaataaattcaagtttgtatatatcttttaaaaggtatatgattaagaaaaacggcaggaggtatctgaatgaaatcacataaatattggtctatcggtgcactgattacaatgcttggaactttttatacaggttataagggatcaaaagaaggccataagtactttgcagcaagttctttgctttgcatgattatggctatttatacaggacacaagataatttctggtaaaagtaggaagaaaaaagaagtttcagtagagagtgttgaagattaaaaaacaaaatattttaataaataacgccggtgcgggatttttgatatccagtaccggcgttattgattctacaggggcttgggggtgtagccaccaaatatactactcgttttctgcttcggcaagtttgttaaggatccactccctattgataactatttcatcatcatcgcggagatccttgaaatcattgcagtgtgaagaagcaaattcatacatattgtcaatgtcaactgcaccagtaatctcacccttattaatgattacaagaatatttgttccgtcgtcgtcgacagcaaagcgcagttcatcaaattctatatcgggatcatttttgagaatagaatctgtcgcaagtaatttaacaagttccattaccctgtcatctttacctgcatcaaagatctggatcttttcaacgagctgatttgctgatgtcacaatccggtataagtacttttcggtacgataatcagccaaagcatttttttcataaaatatttcatatgtcttctttacttctgattcaggaaccagataaatcatgacaagatcttccatctggtgatagagtgtggagtagtttaaacgaaaggtctctccacagctcgggcaggtataaaggaaaatagattgattaagtaccttctctttcatttcaggatccagtgcagtattaatactgtcccagagctcaaaatccccctcatgatggcaggaaggacaagttactttttctatatgatgtcttgacataaatgttcctcctttcagtgagataaatctatagttttcttattgtagaatgcgcttatcctttattattttgctaggaaattactctgaatctccatcggcatatgataagcctggcctcgttttgtcaggctgtatagtttaaagctcatgagttccggagttgcattcagagaactgcagagtccgaaataatccaggtcttcgttctgaaccatatcttcgatctcctcatcatcaatcagaagatcggcagcaaacagattggcctggtattctgtattatccgtcatattatagagtgtatcatcttgcattggagccattttcagctgggaacgatgcaggatgatatgtcctaattcatgggcggcaacgatcatcttttcttcttctgaaaggaaactactgatcatgacatagattgtcttacagctcatgaagcaatagcctttcagtgttttatatcttgaagtttccccaacaacaatgttcatctgatccatgatctcaaagggatccctggtgccatatttcttgattaatttctttgtttctgtatatatgtaagtgtttctcaaataaatcacctcaaaagtaaaaaataaaaagggcagaaatatccttgtaactataaggtaacagattaggtgtacaataatcccgccttctattatttttcctcttggtttttcagatattttttcggtgtaaatttctttgcacgtcttttggaatccagataaaggctctggatttcatccataaaagctattttatcttcgtctgtcagtgatccaccggcaaacatagctgcagcctgttccagaatctgctgagcctgtctggcaccacggttaccaaactgttcggatgcttctgtgataaaagcttcattctcactcatgagataagaaacgtcacactgtaatgcatctgccagtttctgatacagaacattttgttttggaaaacgtccttctacttcccaggatcgaatggtcctatatgaaacaccaaccatactggccagttcctgctgactcatctttttttcttttcttaatgatcttactttttcaccgaatgtcataaacatacctctttctaagccttgtcttataagtttcattagccgcttcaaggcaaaacgggaaatgtgtctcctaaaaaataaaaattaatcttgacaaagggaaatatctctcctataatgtgaatcacagataagggaaacatctttcctataagatacacaatatttcctcttttgtcaatggatatgtgaaatgaatttcctgtaattcaatgaaaacaggaaggatagacaatcattgatagtcaaaatgggatacatgttacaaaaagaggaaagacgtatgggaggtgacaatgtgagtcaggatcagacttctattatctgtattgatctaaagtccttttatgcttctgtagaatgcgtagaacgtggactggatccgtttaaagcaaacctggtggttgcagatccgaccagatcaaagtcaacaatctgcctggcaatcactccggctatgaagtctcttggcatcaagaaccggtgccggatccatgagataccggattgtgtaaagtacatcacagccatgccaaggatgcagctgtatatggattattccgcaaagatctatggaatctatctgcggtacgtctcaaaagaagatatccatgtgtacagtgtcgatgagtgttttattgatgtgacaaactatctgcagctttatcatctcactgcaaaagaaatggcggtaaagcttatgcaggcagtcatggaggaaactggcatcactgcaactgcaggtgtgggaaccaatctgtatcttgctaagatcgcaatggatatcgtagcaaagcatgtggatgaccatatcggaatcctggatgaattctcttacagagagaagctatgggatcataaaccattaagtgacttctggaggattggatcccggactgaaaaaaaactggccggttatggaatccatacgatgggcgatatcgcaatggcttctttaagatccgaagactggctgtataagatgtttgggattgatgcagagctgttgatcgatcatgcatggggctatgaaacatgccggatgagtgacatcaagaactatcattcggaggaacacagcctttcaaatggtcaggtgctgatgcgaaattattcttttgatgaagcactcgtgatcgtaagggaaatgacagacaacttggtcctggatttgtttgaaaagggactggtgacaagttctatcaccttatggattgcatacgaccacaggtatgagcatgaggcatctaaaggaaccgtaaaactcgaaaaaggaagtaacagttccaaaaagatcatggatgcagtggaagatttatatctcaggattgcggatagatataccggaatccgaagaatcgaggtgtgtgcgaacagggttgctcctgaaagttatgtgcagtacagcctgtttgatgatcccaaacagaccgataaagaacggcatttacaggaagcagtattgaatgtaaagcagcgttatggaaagaatgcgatcatgcgtggatccaatctgctggagtgttccacctatagagaacgcaatgaacaggttggaggacaccgtgcttagaggaggtgcgaatagtgctggcaagtgcatatcaaccgtatttatatttaccaagaccggtttccaggagacatcccatggacgtaggacgcagggcaaaacagtttgctccatttgcggcacttcgtggactggatgaaacgatccggcaacaggaaatcatttacgaaccaaaaagagatttatctgaggaaaagaaaaatgagctggatatgaaattaaggatcctggcatatggaatgaagatacaggcaacttattttcaaaagtcatggaagaatccattaattggtcagtaccatacattatctggaaccgtagaattttttgatccatcagtccacttacggattgatgataccgagatccagatccaggacatctgtgatctgactggtgatgtatttgaaactattgaaatatcatgttaatgaatcacagcggaattttttataccggaaagagtgagtggtagctggtgaaaggataaaaaaggatgcacagatcgacaaagcagatctgatcagaatagaaatcgtgctgttcgtgtagctttggcacttacggaatggatggcatgatgctcataaggcggatttgatttccctttggtccgttgagtaataaatggagaaatatcttattgcttaaaggaggaagcctatatgggatcaggtgctattaaatggcatgtacactgctctgtatgtggagcatttattgaaaagagcgcacaaagcgattcagaagtggagtgcaaaaaatgtcgcagtacattggagatatttgtaaaggatgatatggtgtcggttcgtccgatccacatccgagatgaacaattaaagtccaggatgcggacgtattcccgaaagatgatgaatcagggatcataacagaatagaatgagctgtctgtagtaagcgttggatttggcaggaaccatcaagaacgcaccagacagcaagagtttgtcaaggagctgaacctgactggaatcactaagagcccggcaaaacatttacggatacactgcaagatcagaagtattttctggttttggagattgttgaagtatttgttttgtcgggcttttttgacgtatttcgaaaaatttttaaatttttttgtcgtacaccactgtaaaacaggctctcagcgtttcgttatatagaggttgaattcttttttgcaaaaataattgtaaatagagattttgataatatgacacaaaggaggaagcaaagatgactgaaatcgaataccaggaatttgtaaggcgttgtccttacgatgctatgggcgattattccatgtttcgcaaacagcaaacagagaataaatcagagtgcattcagtgcaaatcccaaaatgagcagtaatctaacatactaattatgtaagcagattatgcgttatcaaggagtcgcggactcccgttcaaaaaaaacgggtgagttcgtgacctcttgcgctgcagttctttatgtctgtgcagaaatttcataaaagatggaaagaaccacccggagccgaaaggcagaaaggtggtcattatgttgacattaaaagaactgaagaagatcgtgaaggttgctgatatggagaaaagaatcccaagcatgaaatccttgaaagaacacaaagttgtagtaaaagaaatgatcaatgcagatacaacgatctctgtttatgatcacggatatgtgctttatacagcgggaaatcaatcaaccgtatttccgcttcatagttgtgatgactatgaatatgtgagtgtaactggcgataacaaggaattcaataaagagttctttgataatgaaaactggtatatccgtctgctgatggaggctgaagaccgtatggcatacagccagagcaaaatcagcaccaatcatggtgtattttctaacagcgatgttacagatgatgcggagattatgagaggatcttcaaaagattttgttgacgatgttatcgacagagaaattctgaatgcgctgatcaaggaattgacagagaggcaaaagacggtactcaatctgatttatttcgaagaaatgcgccagcaggatgtcgcagattatctgggaatcaaacagcagagtgtaaatgacctcctgaacagggcattaaaaacgatgaaaaaaaaggctgaaaacgaagaattttaaaaaaattgaattagaccactgtaaaacaggctctgagcgtttcgttatatgaagggtttgcatagaacacctttatgtaccttgaaaaatgaatagcctgcccggagtgatatttggtttgaacatgcatagagcgaaaagctgcgtgtctgccagaagaaaacgtatcagagatggaaactgatataggaacggatctgggaaagaaaacaggaaaacgcttaaatcttaaatcaaaataaaatgtctgaatctaaaaagaggatgacagtagaaatcatgtggcggtatttgtgacaaacaggtaccgccatatatttgtgctgttatctcagcttgtgctgactgtcccaaatagcgcaaatttcaagaaaggaggtgattatcttcgtataaaagataatatgcagaaactaacagataaccatacacaaaagaatcagaaaggaaggatttaagagaatgaacgtgaaaaagaaagcacgcagggtgatgtccggtttactgactgcagtaacggttctatcgacggtactctctcccgctgttgcctatgcttctgatgatgctggatctgtaaaaaagattccgcattatgaagagatcaaggatcagctggatgaaaatgaagtggtaactgcaaaggattatgagatcaaggttggagacaatttcgatgtaaagaatgattataccggtcttacgatccaggatgacagcaaagtaaaagttacatttcaggaagcaaaagatacggacgggaatgatttttctaccgattatgccaattcctataaggcagtctattatgtagaaccacagacaacgaatcacccaacctaccagatcaatcgaaagatcgtggtaaaagaagcggatcaacagaaagattcgcagtcagaaagttcttctgatcaggatactggttcttccgataagacagaaacagaggattctgaggctgactcgtctacagaggaaactgatgcggctgacacggagagcaaaacagaactgacagaaaaagaatttgatgcagagatcgaagaaacggaggatcaggagaccgttgatccggaaacagggattacactctcagaggttatgcaggaagctgttgaccaggatgttgctcttgcagatcttgaagcaggcgaaagtattactttcgatatgccaatgatgcttgcttctggtgagacaggaacaaaatcagtcactgttacagctggttcctggtactattatgcagactatggattaggttcttatctgacttgtccatattatgtgaaatggggaagcatcaatgcgacagcatactgtgttgaaccatcgaaaaaaggaccgggaaatggaacttatacgatccagaaacttgccgatggaaagacacttgcaaaggtctgctattacggaacaaaagcaagtgatgagaatggtttcttcgatgagaaacatccggattttccggcagaaaagagattcatcattacccatcttgcagcagcttatgcaaatggatccagtgactgggcatccggaaccaatgcaacaggaaagaacctggcaatggaactttacaattattgtgtaaatatgccggacattccgtctgtagatatgagcttttccgaatctaatgtaaaggcttatgtggaaggaaacagccagcgaacaagcgtgatcacattcaaagcagataaactgcagacaatcacatttaagttgccaagcggtgtaaagcttgtaaatgtgacaaccggtaaaaccagtgctgcaggagcaagtgtagaaatcagtggaggtacacagttttatctgacagcaccacttgatcaggcagagagcgtcagtgttacattttcttctcggatgaagggaagcattgataaagaatactctgcttacaagattgtaacaggatccggaacacaggacctggctcttgttttcggtgaaggtgtcggaaatgagaaatatgtggattttaaagtaacctggacaaaagaatgcaaggtatccattgtaaagaaagaccaggatacaggaaatgcactggctggtgcagtgtacgggatctattccgatgctgcatgtacaaagctgattgcagagatgcctgcaacagatcagaatggtgcttcacagctcacaatggaaaagacacaggaagttgtttatctgaaagaaatctctgttccaacaggatatcagatcgatacaaagtcttataatgtgactcttgctatcggaaagacaacgaccaaaaatgtaacagacaaacgtgtaaatgcaaagctcaacattgcaaaacaggatgctgagacagggaatgcagcacagggtgatgcaacgctggaaggtgcagtatatggtctttatgcaagggaagatattgttcatccggatggaagaaccggaacaatccataagaaagacagcctgatcacatccctgacaacggataagaatggcgaagcttctgtatcagatctctatcttggaaagtattatctgaaagagcttagtgctccggtgggatacgtactggatccgacagaacatgaggtggactgtacttacgaaggtgctactgttccgacagtagaaagaacttctgtatgtaaagaaacagtcattaagcagccgttccagatcattaaagccgcaaacaatggaaagaccgatgcagatcttctgcagggagtcggtttttcagcatggcttgttagtgatctgaaagtaaaagcagatggaagttatgattttgactcagccagaccagttgtactgactgcagatggtcagacagaaatgtttaccgatgaaaaaggatatgcaagatcgattccgcttccatatggaacttatgtggtaagagaaaccacaagcaaacacaactatgcatcggttgatgattttgtagtgaagatcacagagaatcatccggatacaccgcagacatggcgagtgctgttggataaagaattcaaagcaaaattaaagatcatcaaaaaggatgcagaaacacagaaatcggtactcctggccaatactgagttcaaggtatacgacctggataaccagaaatatgtggaacagacaacatcctatccgaagccaacggtacacaaatcctatttcacaaatgaggaaggatacctggtactgccaaagaatctgaaacctggcaactaccggattgaggaagtgacggcacccgatgggtacacaatatccaaaaactatgtgacagtcgctgttgatacagatactgcttatctgacagatcctgtcacaggagatgcagtcattgatgtggaatataccaatgccccggtcaaaggtcagttaaagatctataaacagggtgaagtgttaaaaggatttgagaaggatttccagtatgaaatggctggccttgcaggtgcagaatttgaagtctatgcggcagaggatatctatactgccgatcatcaggtagatgcagatggacagagaactctgtattttgcaaaggatgcactggtagcaaccgtcacaaccaatgcagatggttatgcaaccgtaaagaatcttccgcttggtagatactatgtcaaagagaagaatgcaccggacacttatgtgttaaatactgtgtcggaaaatgtcgaatttgcttatgcggatcaggatactgcagtgatcgagaaagaaatctctgtcacagatgaacgacagaaagtatcgattactgtcgaaaaacaggatgtcgagacaggcaatacagtagccggagcagtattcggtatttataacgcaaaagacatccagacaaaagatggaaacgtgatcgtcaaagcagatactcttttacaggaaatgacttctgatgaaaaaggtcaggcagcttgtacgctggatctaccacttggaagctattatgtaaaagaactgaaagcaccggacggatttgtattatctgaggaagtattgagatttgatgcttcttatcagggtcaggaagtacagacagtgaaactgaaatctgcagtgaagaaccagccgacaactgttgagatcacaaaatcagatgcaacaaccggtgtagaactggatggagcttatctgaaagtaacggataaagatggaaatgtagtagatagctggacatcttccaaagatgcaccgcatgtgatcaaatatctgaaagtgggtgagacttataccctacatgaagagtttgcaccgcatggttatctggtagccaataatgtgacattcacagtcaaagataccggagaagttcagaaagtggaaatgaaggacgaggtaccggttggtgaactcatcatcaacaaaaagggagaattcctggattctgttacactggccgataaggtcaaaggtgtggtggaacacattttcaactatgtaaccggaaagctgacagatgttacgtttgaagtctatgctgaggaagacattaaggctgccgatggcgtcagtgacgattactataaaaaggatgaactgatcgcaacgatcaagacagatgaaaccggtattgcaaaactggaaaatcttccacttggtaaatactatgtgaaagaaacaggaactgcttacggtcatgtactggatggtgagatccgtcatgtagatctgacttacgtggatcagaatacaccagttgtagtctatgacaaagactggcagaacaaccgccagagagtagaagtcactgtacttaagaaagaaaaagattctgaccgtacattggaaggcgctatctttggattatttgccaaagaagacattaagtctgagacaacaggtaaagtcctgattgaagccgatgagatcattgaactgaaatctacggatgaagaaggaaagatcacatttgttgcagatcttccaataggagcaacttactatgtaaaagagctctatgcaccggacggattcgtaaccaacgatgaagtaaaggaatttacgtttgagtatgcaggtgaggatcagccgactgtaacctatgattttacctttgagaatcagccaaccattgtagaatttaccaaatccagtctgacaaccggaaaagaacttccaggatgtaagctgaaagtggtagatgctgatggaaatatcgtggatgaatggacttccggtaaagaagcacatgtgatccgtgagctgactgtcggaaaagaatacacactggttgaaacaaaacctgctgatggttacgtgacagctgaaagcgtgaagttcacgatcaaagatactgccgatgtgcagaaagttgagatgaaggatgatgtaacgaaggtgaaaatctccaaacaggatatcgccggaaaagaacttccgggagcgaaactcacaatccttgatcaggatggaaaagttgtggaaagctggaccagtacagagaaagcacattacatcgaaatgcttccgatcggaaaatacactctccgtgaagaaacagcaccggatggctatctggttgcaaaagatgtggaattcaaagtaaaggataccagtgtagtacagcatgtaaccatggtggatgaggaaaaaccggcagaaaagacaccggaaggtggaaaacctgtcagtgattcaccaaagactggggataacaccaatctgtggctgtggtttatgcttctcggcattggtgcgactggtacaggagcccttgcatttatgagaaaaaagaaacactaattaaataagaatgagcgttcatggaaaccgaaaggaatctgtggacgcttttttagatgggagaaaccatgagaaatatcattatttttgttgctcttctgggagcagcggcaatatttacagttttgtattgtctcattgctgccggaagtcaggcagagaaaaaactgacagaaatcatgagaaaagaggaagaacagaatgaagactaataaagatctgatcatagaaccaaatgcagctattgagggaagaaagtacagcgaagaaaagccatggtcctgcaagtactgttactggtggggaggcaaaaagaaaggctgtagcttgaaacagtgccactatctgcttccggaaaagaaaaaagcagtaaaaacaacaccatgtggtggctgtccgtatggaaaacatgttccatgcatcggatattgtattgcccgtctttattctgagatgaaaggaaagaaaggacgtgggtaattgcaggaagaagtaaatcagaaagtgatcagcctgagcatccagggagtcaagatcactgccagtgtgctaaaagcagcccttcggaagttcctggaaatggacaaccgcaggaaacagaaagcaacgcaggtgaaaatggcagaaaagaccggacgggctcaggagaaaggaagggaaaaagcccgaaaaaagattgaaaagaaaaagccgcatggaaagcagaccatcaagcagctgaatgcacagggagtacagctttccaacttaaagatcacagatgaaaatatcaaatcctttgaccgtgtggcaagaaaatacggcattgattacagcttgaagaaagaagttggtgctgatccaccgaaatatctggtcttctttaaggcaaaagacgtggatgtgatgacagcggctttccgggaatatgccggagtagaactgaaaaagaaacaggtgaagaaaccatctgtcagaaagaaactgcagaaatctgtagaaagaaaagcaaagcaccgccagcgtgtgaagcagagacaaaaatccagaggtcaggaacgatgattagggaaaaattacagaagatccaggtcaaacggctggtggtcttaaatctcccatatttctttattttctatgtagcagataaaggatcctggctgtaccggcattgcctgggagaaagcatggtccagagacttggcgtgatgttagtcaatttccgactggcatttttaagctggctgccaagtatcgctttgcaggatcttacagtaggtgttctggttgcaggtgcattaaaactggtggtctactatcgttctaaaaatgcaaagaagttccgacaaggtgtggagtatggatctgcaagatggggaaacagaaaagacatcgaaccctttatggatccggtctttgaaaacaatgtcatcctcacagaaacagaacgtctgaccatgaacagccggccaaaagccccaaagtatgccagaaataagaatgtgatcgtcatcggtggttccggatccggaaagacaagattctatgtaaaacccaatcttatgcagatgacggatcacgtgtcctatgtggtcactgatccgaagggaacgatcatcgttgaatgcgggaagatgctggtaaatggaggataccggatcaaggtattaaatacgatcaactttaaaaagtccatgcattacaatccgttccattatatccggagtgaaaaagacatcttaaagctggtcaataccattattgcaaataccaagggtgaaggcgaaaaatcaacggaagatttctgggtcaaggccgaacgtcttttgtattctgcactgatcggatacatctggtatgaggcaccagaggaagaacagaacttttctactctgttggaatttatcaatgccagtgagaccagggaggatgatgaagaatttaaaaatgcagtggatgaattgtttgaagaactggaagcagaaaatccggaacactttgcagtaaggcaatatcgcaagtacaagcttgcagccggtgttgtatgctctaaaagacttcttaatcaagcggttgggaagtctcttagaacacacaacctaaaaccgaagaaaggagcgcaagttatgagaaaaaacgagaaaatcactgctctgtacgaacgactgagccgtgatgactttggcaaagatgatgaccaacagcgtgagagcaattccatttccaatcaaaaagctatgttggaggagttcgccgcacggcagggctttacaaacattgtccatttcacagacgatggcattagcggcacctgctttgatcgccccggatttttggcaatgatgaaagaggttgaagccgggaatgtggagtacctgtgtatcaaggacatgagccgcatgggtcgtgactatctgaaagtcggtcagattatggaaattctgcgtcagcgtggcgttcgccttatcgccatcaatgacggcgtggacagtgccagaggggacgatgattttaccccgttccgcaacattatgaacgagtattacgccagagacaccagccgtaaaatccgttccactttccagtcaaaaggcaagtccggcaagcaccttacaggcacggtcatttacggctatctctggaacgaagccagagaccaatggttggttgaccccgaagccgctgatgtggtcaagcgcatctttgccatgacgattgagggctacggtccgtatcagatcgccagcaagctgaaagaagaaaaaatcctcattccgtccgcttaccttgcccaacacggcgagggcgtgaacaaaaacaagactttcaaagatgtgtacggctggggttcttccaccatctgcaacattcttaaaaagcgtgagtatctgggacacaccatcaatttcaagacccgaaagcacttcaaggacaagaaaagccattatgtcccggaggacgaatggacaattttcgagaatacccatgagcctatcattgaccagcagacctttgaccttgtgcagaaaatccgtgggaatgtcagacgctacccggacggctggggcgaagcggctcccctcacaggcttgctttattgtgccgattgcggcggcaagatgtatgtccaccgtaccaacaacggcaagcgtatttctcaatatacctgttcccaatacagcaaagtcccagttggaaagctctgcacgacacagcaccgtatcaatgaagatgtggtactgtcccttgtctctgaaatgctgaaagccattgccgagtatgccaagcatgaccgagccgagtttgtccgtgtggtgcaggaagcgcagtccagccagcagacagcagaggtcagaaaacagcgaacacgccttgccacagcaaagcagagagtttccgagctggaagtcctgctctgcaaaatctatgaggacaacattttaggcaagctgtctgacagcagatatgccactctggacgctcaatatgaaaaggagcagaccgagcttaccgccgaaatctctgttctggaaaaggctgtcaagagctatgagaagcacgaaaaggacgctgaccgttttatcgctctgattgataagtatgagaacttcgacaagctgaccattgccatgctcaacgagtttatcgagaaaatccttgtgcatgagcgtgaccgtaaaggcagtatacagaccacacaggaggtcgagatttacttcaattttgttgggcgattcgttccaccggcgtttggcgaagtggagcttaccccggaggaattagaggaaatccgcaagcgtgaggaacgcaaggacaggcttcatcagaactacttgaagcggaaagccagcggagcgcagaagcgatacgaggacaaaatcaaggggagaaaaaaggcagaaatcgaagccaagaaagccgccattcgtgcggaggacattgcaaagggagtgttcgtccctgtcagcagtttaccgcagagagagccgatgaaaggagtgcaatcagcatgaatatcacttacacacagaacggagattatcttatcccgaacatcgttatccgcaagacaaagcccctcggacactacggcagacttcgcaaagcgtatttggaaatgcaccgcccgatactgttcaatgagctggcgctatccgacaagctctttgagcattgcgccgagattgacgaagcggcacgaagccgcatggaactgatcgtgccagagctggcaaagcagtacggcgtgacagagcaactgaaagccgaaaaccaaatggaatgggtgcggcagatgaacgtttgcaaggcgcaggcagaggaagttgtgaaagcagagttgatttataattgagcgaggaagtccaggcagaaaactgttcggacttttctcatatgttccaaaatgacggtagaattgttcacaagttttatggtataatttgaatgtgaaaattgagcatcaaactggaattgatataaaaaaggaggacacatagatgaaaacagtagttctttataatattatttcttttatcatcatcgttgctttgatttttgtcttaaggattgttagtaagagtaatttaagacaaaatcaacaacttgttattaaagtcattgcaactattttaattgtttgtgtgatagcgttcgtgctttttattgatgcaatagcatttggcattataggaccagttccaaattaacaattccagtttgtcgaactgataaaatccctttaggaactaaagggcgcacttctatactctctgtcgagagtagtgcgtcctgcggagcttcattctctgtcagcagaagaaaactgcctgacctcgaatgtttccgtcacttcgtttcgacaaggtggctacacccccttgcgccgcttatgcggctatcccctgtggacttgccgtccgcaaacagcatgaaatgctgttcgccgccagcaagtttgattttgaaaatccaactaaaaggagaagcataattatgaaacggaaattggtaatgttactaactattgtagcggttctcgcagtagggattggtatctggtacaatgttcctattaacttgatggatttggaacatgatgaagttatagaaattgtcgtattcaatggaaatactggaaatgcaactcacatcacagatgagacacaaatcgaacatattattgaaaatctaaatgaaatcaagttaaaaaggtcgaagccgtctgttggttattctggatatagctttaagatgaccatttatttatccgatggtaatgaagccgatgattggaataactttatcatcaattccgatgatactattcggaaagaccctttcttttacaaggtggtttcagaaaaaattgattatgattatatagctggtatcgtaaactaaagtgagataatcattgcaactgaatactaaaaaacagaccgttgatacacatgaccgtgtgaaaaaatcagcggtctttttttatacccattttcaaaaaaggaggtcatgaaacatggcaaaaacgaaaaccctcgaccagcttagagccgaaaaagaacaagctgaagctcagcttcttcaggaacagcacaagctccaaaggctggaacagaggaagaaacactatgagaaaggcgaacgcaagaaacgcacccaccgcctttgcaatctgggcggcatggtggaaagcgttgccccggaggttaaggacttgacacgcaccgaaatgacagagctgatggaacacatcttttctctgtccgaagtccagcgagccgtccgtcacatggcgattacccacatcaacaaagcgaacggaggaaaggagttgaaagccgatggcactatttcatctgagtgtcacgcagactaagcgaagcgcaggacagtccgctatcgcttctgctgcctaccgagccggggagcgattgtatagcgagtattacggcgaatacagcgactacacccgcaagggcggcgtgatctgctctgacattctcttgccgtcccatgctcccccggaatttgcagaccgtcagaccttgtggaacgccgtggaaaaagccgagcgtggtaagaacgcccagcttgcatacagctttgacattgccttgcagaatgaattttcccttgaggaaaacatcgctcttgcaaggcaatttttattggagaactttgtgagccgtggcatggtggttgacttcgccgtacaccagccagaccgggaggacggcggcataccaaacccacattttcatgtgctttgccctatccgccccatcgagcagaacggcaaatggggactaaagcaacgccgggtgtatgagctggacgaggacggcaaccgtatccgagacgcagacggaaagtttgtgttcaacgccgttcccactaccgactggggcagtcccgaaacgctggaatactggcggcagacatgggcggagctatgcaatgccaagtttgcggaaaaaggtattgatgttcgtatcgaccaccggagctatgagcgtcagggcgtggagcttcttcccaccgtccacgagggcgcaaccgtccgggcaatggagaagaaaggtatccgcaccgaaaagggagagttcaaccgctggatcaaagccaccaatgccgttatccgggacatcaagaagaaaatcactctcctgtttgattggattgccgaagcaaaagcagagcttgccaagccacaggcacccaaccttgtttctctgctgaacgcctattacaccagccgcaacgccggggcgtattcccagaaaggcaaggtcagcaatctaaaggagatgaacgagactttcaattatcttcggaagaatggcatttacacccttgaagatttggaaagccatgtcaacgaacacagtgctgccacagagagcttgaagaaaacgctggacgaacagaccgcccgaatgaaagcaattaagcagctctatgacagctccgctgctttccagagcttgaagcctgtctatgacggcttgcagaaaatcaagtttgagaagcccagagccaagtacaaggcagagcatgaagcggaactgatacagttctacgccgccagacgaaagctgaccggggagttcccagacggtaaggtggatatgaaaaagctgaccgaagagtatgacgagctggaacaggtgcacaacaccacctatggcgagtttaagaccgtcagagacgatttacaccgcctttggaaggtcaagtcatgtgtagatactgccgcccgatttaacgaacgcacagaggaacaaaagctccaaaatcgaccccaaacacgacacaaaaaggaggaactatcccgatgaattatacccaagcacagattgaccgggcaaacgccgtcagtctggaagattttctccgtacacagggagagacacttgtcaaaagcggacgggaataccgctggaaagaacatgacagcctgaccgtccggggaaacaagtggtttcgccacagccagagcaagggcggctatcccattgattttgtcatggagttttacggcaagtcctttcccgaagctgtccagctcttaaccggcgaaagcggtgagggacagagcgaagccagcacagcaccgcacacagcgtttcacttgcccttgcacaacaggacagccgacagagcaatccaatatctcacagaaagccgaggtctcaacaaaacgcttgttgaggcttttcttctttccggggatatttacgaggacgcaaagcggcacaatgttgtgtttgtcggcagagaccgaagcggtacgccgagatacgcccatgtgcgaggaacggcagacccattcagacaggacattgccgggtctgacaaatcctatccgttccactatgagggaaacggcaaccagctctttgtctttgaagcaccgattgaccttttgtcctttatctgcctttatccgcaggactggcagacaaggagctaccttgccctgggcggcgtttcaggcaaagcccttgaccgtttcctttctgaacgcaaggacacccgaaaagtgttcctctgccttgacagcgacaccgcaggaagtgaagcctgcacccggctggcacaggacattcccggcgagatcgccgtcattcgccttgtcccggcaaggaaagactggaacgatgttctccgtcagcaaggggacattcccagccgcaaattcatagccgagacaatcacgctgcgagagctgcccaccgcccagcctgttcccatgctccgtatggctgatgtggagctgacgagcgtggattggctatggtttccgtatatcccatttggaaagctgaccatcatacagggcaaccccggcgagggcaagacatactttgccatgcgtcttgcggcggcttgcaccaaccgaaagcccttgcccggtatggagacccttgagccttttaatatcatctatcaaaccgccgaggacggtttgggcgataccgttaagccccggctgatggaagcggaagcagaccttgaaagagtgcttgtcattgacgatagggacacaccgctgatccttgccgatgagcgcatagcaagggcaatccgtgagaacaacgcaaggcttgttatcattgacccggtacaggcgtttctgggcgcagatgtggacatgaacagagcaaacgaggtgcgtccgatattccgcagtctgggagacattgcacaggctaccgggtgcgctatcgtgctgatcggacacctgaacaaagccgcaggaacgcaaagcacctaccggggattggggtctatcgacattacggcggcagtccgcagtctgctttttatcggcaagctgaaggacagccccacaacgagggtgcttatccatgagaaaagctcccttgcgccgcccggacagtcccttgccttttctttgggagacgagaaaggctttgaatggataggagcttatgacattaccgctgacgagcttcttgccgggacagacaccgccaagaccgaaagcaagaccgcacaggcgcaaatgatcattctggaactgcttgcagacggaaagcgtatgccgagcgcagagctggaaaagacggtcaatgagcgtgggatttcctcacgcaccatgagaacggcaaagagtcgtatcggggacagacttgtgaccgagaaagacggcacagcatgggtctgctatctccgagactgacaacaggaacacggcaagcgtggcaaagacggcaaggtttttatagataccttaatgttgccgccttgccttgttccctcataccgacaccgcccgatgatgaatagttaccgggcactttttcatttacaggaggattttgaatgaacaataccgcaaccaacaccgctacttgcccgactgtcagaaagcagattggcaagaccacctatatcgtccgtgtccatttcagcgagaccgccaaagagacgatggaggacaaaatcaagcgtatgcttcgtgaggaagtccgcaaaatgtgacttctttgtgaatttgatgaaaaagtccttgacttttcgtctctggcaaaactgcaaaatcgattttgatttcctgtggtgccagacttgcaccatttgacattcaggaactaagagaaattatgtcgtatgacgaaatggaactggatatgatcggtgatcagagaacagccatgtttgtcatcatcagcgacacagatgacacattcaactttgtggtagcgatcatgtacacccagctttttaacctgctttgtgataaggcggatgatgagcatggcggcaggcttccctatcatgtacgactgcttcttgatgagttcagcaatatcggacagatcccaaaattcgacaaattgattgctacgatccgaagcagggaaatttccgcttctatcattctgcagtcacaatctcagctgaaaaccatctataaggatgctgctgagacgatcacaggtaactgtgacactgttcttttcctggggggaaaggaaagttccacactgaaagaaatatcagaaaccctgggaaaggaaaccattgatctttacaacacatcagacaccagaggcagcaaccggtcctatggactgaactatcaaaagactggaaaagaactgatgagtagagatgagctggcggtcatggatggagaaaaatgtatcttacagcttcgaggagtccggccgtttttaagcaacaagtatgacatcacaaagcataaacggtacaaagagcttgccgatttcaataagaataatgcgtttgatgtagaaaaatatctggcacaccgactggtgatgtcgaaagatacagaatttgaaatgtatgaagtaactgtaacacaagaagatgtatcagcgattgaagctgaggaaggtgaggactgatatgaaagaaagaattcgagcaccctgctactactgataagggtacaaaaaggtctgaataaaagggaaaggagtagagccaaacgcttacagaccataagaaaagcgtttgttcatacatttgattatggctttttttagcagtgcaatcaatatccttcagacactggtcgttgcaatcggtgccggtcttggtgtctggggtgtaatcaacctgatggaaggttatggaaacgacaacccgggtgcaaaatcccagggaattaaacagttcatggctaattaaagggaacaaaaagaaaggaaaagccaatccagacggtatcagcggcaggctacaagaataaattgtgatttcacaagattggtgctataataagagaaaagttcctgccggggcagccgctccggtggtatggatagaaaggcaggaaaacaatatgcacatcagctataaaccactctggcacacactgttagagcgtgatatgagaaaagaggatttaaggcttgccgctggtatgacaacaaatatgattgccaacatgagcaaagagggaaagcacatcagcatggatacattagcccgtatctgcgaaacgctgaattgtgagattaccgatgtgattgagttagtaccagacgagcctgcttccacaggaggtaaggaacatgagcgaattgaaaccaagaataaaagaaaacggaattgattatatccttgttggagattactacatcccggacttgaagttgccggaggaacaccgccccatcggaaagtacggacggatgcaccgggaatatttaagagaagtctgcccagccagattacacacattgaccctgaccggggaattgtggacatatcttgcagacctgaacgaacaggcacagaaacggttagacaccatcatggagcagatgaaagctgccgagggcgtgaccgaggaattgaagcgtacccgtcaaatggaatgggtgcagcgttgcaataacattcacaaccgggcagaagaaattgttttacatgagatgatttattcataacggtatggtagaatgattattacaaattagaagttgtaaaggagactttgtatgggtagaaaagaaataacaacaaaagaagatttaatgaaagtaatagaattattcgaaaatactggaattacatactggttggatggcggatggggtgtagatattttagctggtaaacaaacaagaattcatagagatatagatataaattttgatgctcaacatacggaaaaattgttaaatgtgcttttgaatctgggctataaaattgatacagactggaaaccggttagaatagagttatatagtgatgaacttggttacttagacattcacccgttcgttttaagtgaggacggaacttcaaaacaagctgatttagagggtggctggtatgagtttgaaaaagattactttggtagtgctttttttgaaggaaaaacaattccttgtatatccttaaaaggccaaagagttttccattcaggttatgaattaagagataaagataagcatgatatttcaattcttgaaagtttatcaaaataacattgctgtaatttctaagataaattccactttatcgctttgaaattttaactgaataagtatagcaccaaccgctgctacatggaagcaaacacaaccatgcaacagcggtttttctttaccgttttttcctttgactgataggagttcctgttttctttgatttttgtagaatccgaatgagccagcgaaattcttcgtctgacagatttttatagttgatgccgagctgcttgcagtaaaggacaaccagcttttcatcccgactgcccttgaaattttcaaccgcttccaaattttctttcaattcatcggcaacggtggtctggggcgcactctcgctgtcctttttgtgggcttcccgaatatcccggataatgagattgaggtcatcaagaaccatgtggctgaaatattcatcatcgctgatatgggcggcttgcagcactttcaaatgcgggtcgtcttcgccggggcgataccgttcaatgatttcatgccggacagtatcgacaagggcgttgaggttttgaatctgcatggtggcaatcccatctacataaatctcaatgtccgcaagaaacttgataaagtccttatgagtggcaagctcacagagcagacggttgttaatccgaccgcctttcagaagtgccaccatctcatcattcaaatgcagctctgttagtggcgtgttgatctgctcccggttctctgtccggcacagcagataatcaacggaaaccccatagaagtctgccagcgtgataaggttgccatgattgatttccttataatcctctttttcataactgccaagagctgatttggaaatgcccgtcagctctgataattcttccagatttaagcctttgtccttgcggagttcccaaaggcgttcctgtatgcttgtcgctcctttcatgggcgcacgctcctttccggcggtttcattactgccgcttaactggattatatcatactttccgcaatcgtggaaatttctgatttttacccttaattcctactttgtggacatacggcacagggcacaaaaatgttctatgatacaggtagttcatcgatggattattccaatcgaatgaccagcctgtgtgggatatgcttccccggcgatgtagcgccatgacttttggcagggatatggaggaaccctgaccgaaacgagcgtaccaaagggagcaatacgccgctgtgagattcaggggaggaacgacaccggggagaactggcgaactgataccgaaatgataccgaaacacgacaatctgatagggggatagtctaccctattgctgatacttctggagattttagacggctctatgaccgtaattttgccgaaaatcgccccgaaactatacactaaaacgggaggaaacgcaatatgccgagaatgagcaaaaagaggaagcatgagctttctttttacctcaatgaccgggggcgtgtcacttacaacgaattatgccggaaatgcaagcatgggtgcaagcagagcttccgggcggttgtggttgactgcccccgttatttatccaaaagagcaaagaaaaaggaggaacacaccgaatgaattttgaatttatgacgataggcacaccgttgccgccctgtatgccctttcccagagcgttgacaggatttccagtcagcagcaccgcaaaggtcatgtactgccggatgttggacgctatgctatccaacggacaggaggacgagaacggaatcctgtttatctgcttccctgtcacagccattgccgcagtcctgtcccgcagccccatgacggtcaagcgttctctgaatgaactggaaaccgccggactgatcatgcgagtgcgtcagggcgttggagaaccaaacaggatttatgtgctgataccgggaaaggaggacgctgcccttgcctgatacctcaaagctggaaaagctcaaccgagagttggaaaagagtgaaaagaaactgcggaaagccatcaatgatgaaaaggcattgcagcaccagctaaagcagcttacccgaaaagaacggacacaccggctctgtactcgtggcggtatgctggaaagttttctgcaagagccggaacgcctgacagatgatgatgtcatgctgttgttgacactcatttttcacaggcaggacacgcaggaactattgaagaaactgctggaacgtgagaagccggaaaccccttagtttactaagggcgcaattatacaccacccaaaggttggtgcattgcgttctccgaaggctccttgccggagggctgtgatttttcgcagtcatggtctgctccaaatcatacaggggacgctacgcttcccctgcgctggctaccgccagctacccttttgtggacttgtcatctggggacaccttgcgttgcaagctgttcccagccgacaagtttcataaaatatgctatcttttcgataggcaataaagtataataaagtcagcaataaatcggaattttacggtcagtaaggaatgcgtaaagttatatgattgtattataagcgatttgttaaatttttataaccacttgtatttgcctgcgatttatggtataatattttgaaatttagaaagaggtgggaagatgattaacttttcttgcaaataaaatcaaaatatgcggtagtgctatactttggcattattgtgtctattgcaagaaagttatatgtctatcttactcaatatagtgctgttgccacttttgcttagtggtgttattttatgctatgacgagctgcaaggataaactttcttgtggctcttattttgttttggaggtgctttatgaatagtgcagaacagatagttacacatgattcactccgtatagtgtcggttccttttggtgaaatctatacgtagtaaacattcaccgaaccgactttgtatcgtatgacatgcaaaggaggataatatttatgtcaatgattaaaattgaaaaccttacgttttcatatccgacaagttatgataatgtttttgaaaatgtcagtttccaggttgataccgattggaagcttggttttgtgggcagaaacggacgaggtaaaacaacctttctgaatcttctgcttgggaaatatgagtatagtggaaaaatcctatcatccgtacagtttgattattttccttatcccgtttcagataagaatcgtattacagaggatatattgcaggagatttgcccacttgcggaagaatgggaacttatgcgagaactttcttatcttgatgttgatgtcgatgtgctttggcgaccttttgaaacactttccaacggagagcagacaaaggttttgattgccgctctttttcttaatgaagggcatttcctactgattgatgaacctaccaaccatttggatgccaaagcgagaaaaagtgtggcggcatatctgaaaaagaaaaagggattcatcttagtttctcacgatcgtcgctttcttgacgattgtgttgactatattctatcgattaaccgagcgaatatcgaagtgcaaagaggaaacttttcatcatggatgtcaaattttgagcgacagcaagaatttgaactggctcagaacgaacgtttgcaaaaggacatcagacgattacagcagtcggcaaaacgcgctgcagtatggtctgaacgtgtagaagcttccaaaattggggcagcagataaaggttatgtcggtcataaagccgccaaaatgatgaagcgttcaaaatctatagaagcgagacaacaacagacaatcgaacaaaaatcagcattgctgaaaaatatggaaaccgcagaagccctcaagatacaaccgcttaattaccatacagatttgcttgcatcattatcgaatgtagtagtttattatgatggcatttcagtttgtgaacccgtttcgtttgaaataagacagggagaacgcattgtgcttgatggaaagaacggcagtggcaaaagtagcctgttaaagttggtagtcgggcagtccatagattatacgggtacagtaacacttggctctgggcttgtaatttcttatgtgccacaggatacatcgtatttatgtggaaccctttccgagtttgcagaagaaaacaaccttgatgaaagtttgttcaaggcaattcttaggaaaatggactttgagcgtgtacagtttgaaaaggatattaaagacttttctggcgggcaaaagaagaaagtcctaattgcgaaaagcctttgtgaaaaggcacacttgtatgtatgggatgaaccgctcaactttattgatgtgtactcacgtatgcagattgaacaactcataacggagtttgccccgaccatgctcctggtagaacatgacagtgtttttcgagatactgtggcaagtaaaattgtgaatatctaaattggttcttccgcaattttacgtttttcgctttaataaaaatggagaatgctgatttacactggcattccagtattgaaaaattacaaaatacggataattgcgtaagaacctctaaattaaaataattgtatgggttaattccagctttacagagactcaaattccagtttgccgaaatatctttctaactttccctattttacaggcttttcagcccattcattagtgaaatgatatgtattttcccttatttttgcccttatgagataatcgtaagggaaataagggaaagttttatttagtcgttgcctgccactttatcaagtaactttgcggattcccgcttggcttttcttgtggaatgggcgtagacattcattgtggtactgacatctgagtgccctaacagttcctgcacatcctttggtgctgctccatttgccagaaggttgcttgtgtaggtgtgtcgcaactggtgaaaatgaaatccttcaaatccatccagtttctgagcaatcttcctgcaaacaattcctaacgtgcttggcagttccaaacttccatccggtcttaagcagacaaaggatatttccttataatcttctggaacattctctgttccgtccagatgatagaactcatagtaaactctgtttttgtcttttacttctctgtagtagtttttatggtaaagttctccgtactgcattcggtttttaagttgttcctttcgggcattgcgaagaatctctgccagtgtatctccaaaatcaacaatccttaccttttttcgtttggttggtccgatgatattcttgtgccttgaaccatcatatcggatactgcgtctgattgtaaggcactgttcttcaagattcacatcctgccatgccagaccacaggcttcaccgatacgaagtcctgcataataagctatctggattggaagtattgccggtggattgtaattctgtagaaattcaatcagtctttcataatcctctcgtggaattggctgtatatcgccatccatgtcatcatcggaaaacaggtcaacctcatccgtctggtatttcagcttaatatactgcatcggattgaaagtgatatattgctttggtgatactgcaaaccggaatgactgctgtaatactgccgagaaagaacgaatgtaatctttgctgtaaccttttctttctgaaccatctggataagtgccaccaaaggaaagcagatcgaagaaggcttgtaaatgctcagatgttacatttttcaactttctctctgaaattggatgcttcttgatgttggtaatagcaccaaggtaattctggactgtcccattactgagagtaccggtctttaattcttcctctgcccatatatcaagtaattctccaactgtaatattttccgactttgcaatgaatttcttgctttcgtaatcgtccattgcctgacggagcagtttttccgtttcacttttgctttctgttccagcgtattctttctgaaccagattgccgcttgcatcttctacatagaagcggtagtaccatttctttcctttttttcttacagatccttttgccataatcgtgtgtctcctttcgatatcagacaatcggaactgatgaaatgcttcttgcgtgtaggcatcttatggacaagtccataagccaattcgccgctcgtcaaatctgtaaacagcctgacttgctcgtgctcattgtatcataactccggttgtcgttctataccgaatcggaatcctcatacaaaacttctgataaaagattttcaagcctttgttctgccatttccggtttcttggaatagagccttacaatatctgccatatcattaaaggcattaacggtatgggtgatctcccggagaaacataatctcgttatattcatcattcgattcaaatcccattgcctttgcaatatccgcttcattcgtgttgcccttgtaattcttgcaggcaaactggaatgattccagaaacaggttatattgctttaacatcaacagcagtaaatctttggaaaaagcatcttcctttttactaaggtcgagaggtaactgtttgagaatatcgcccattgcatcacgaatctgtaattctttcttatccgtaatatcggtttcgtattcatcggtttcccccttgagccattcaatagatacatgaagtgcttccgaaagaccttccagcaccatctttttggtattgtcaatcgaaccattctcataacgcaggattgtggaagcggtaactcccatcttctctgcaacataaggctgtgtcagatttaattccagacgacgctgttttgccctgttacctatcagcttgcgtagttctttatctttcatgctgattgcctcctttttcggtatgtatgaattatagcatgtacctcacataattgcaatatgcaatctaatgattaattttaaaatttcataacgcttgacaacgcaatataaaaccgctatactaacagcacaacaaaaattgcataatgcaatttaacgggaggtgacaagatgacggaaagaaagattgcattatccatcgaggaagcagccgactatacaggaattggcagaaacactttgagaaagctggttgaatggaagaagcttccggtattaaaagtcggaagaaaagtccttattaaaactgacattctggaaaagttcatggaagccaacgaggggcgagatctgagggataaaggaaatgtaaaagctgtcacaagaaatgtggcaacttaaaaaggcggcttcctaagaaaccgccaaaggttctatcagaccgaagccatgatatacctacacgcaagaggattataccatgtgcttctcctgatatgcaaccgggaactgttgtttatcggaaaaagaaaggatgaagacgatatggcgaaatcaacaaagacttatgaagaaagaatacgtgcattagagaaaaaggaacaggaaagcattgaagctacaaaaaagctcattgcacagcggaaggaactggaaaagcgaaagaaagcagaggaaagtaaaaaacgaacccacaggctctgtcagattggtggcgcagtggaatcggttcttggctgtccgattgaggaggaagatttaccaaagttgataggcttcttaaaaaggcaggaaacaaacggaaagtttttctcaaaggcgatgcagaaagagccacttacagatatggaggaagtgtaatggcggagggagtggtttttccattcccttcattgcctttgaatgaagggcgcacttatggacaaccagaggtcgtccttataagtttgccacaagtggcaaccggtctgcgcttacgcttgccgggctcgttccgtcggcggggctttcagccagacctgctcatgccgcagggggcactcttgcgcagagggcgttccgacagcttcacttctgccaaaccagaagaagatgctgtcggaaatcaatgccggatacggcagaaagggggaatcgtatcatggcgatatttcactttacagtaaagattgtcgggcgcagtaaaggaaaatctgtcatatccgcatcggcatatcttaatggagatgtgatgaagaatgaggaaacaggcagaatcagttactatacttccaaaaaggaagtcgtctacaccagtctgatgatgtgcgaaaatgcacctcctgaatggctgcatgtaccggaagaaaatataaaaaggtttcaacagtctatccgttataaaagagcggatgataaagatgccgcactggaaaagtttaaaatcacatttcagaaacagcgtctatggaatgaggtattgaagatagaaaaaaatgcagatgcacagcttggacgctcatttgaattttccctgccgaaagaatggagcagacaggaacagattgattatacaaccgaatatattcaaaagactttcgtggataagggaatgtgtgtcgactggagcatacacgataagggcgatggaaacccacatgtgcatttacttgtaaccatgcgaccattcaatctggatcattcatggggcagcaaagaagtcaaggactgggattttgtcagagatactgacggaaatatcgtggttgatgaatcccacccggactggtggcaggataagaaaaatcctgaccggcatggaatccgcattccggtacttgatgaaaacggagtacagaaagtcggggcaagaaaccgaaaacaatggaaacgggttctgaccgatgctaccggctggaataatccaaagaattgtgagttatggcgaagcgaatgggctgggatgtgtaaccggcatttatccatagacaatcagattgaccaccgctcttatgaaagacagggcaaattaaaaatccctacgattcatgagggtgcggatgcaagaaagattgaggaaaaatatctcaccggacagatatggaatggttcatggaaggtagaggaaaaccagatgattaaaaaacaaaatgcactactgcaaaaggtaatcacaacctttggtaaggtatccggtgcattgtcaatatggagggagtgtttgaatgacattagaagaaagcaaagaagtaattcccatgatggaagcaatgattacacagatcgaggaacagcagaatatcatggcagagatgcttcaggagatacaggaaaaggacgagaagctgatgtgttttcaggagcaggaagaacgattgcagcaattagagagcgaattatcagagctgctacaaatcttaccgaatacagaagaactgttgatgcttctggaagaaaagacagaccagatacagaaactcacagacgaaaatcagcaatggcaggaattggcacagaaattaaacagcgagaaccggctattgcagaaacagaacagcgaattgttgaacttgaacagcaattagagaaaggaaggttgattgatgaacgaattaagaaactcaaagagcgacgatcaactggaagaactgctaatgctgacggagcagatgcaggaagaactcgaccagaaagaccagactatcgagaaactgaaagtgcagctcgacgaatcgctgaccttgaacgagaggttaaacagcgagaacagagtcgggaacattcaagccttaaagaacgacttgaggaaaacaaaagaattattgtagagagagaaagagaaaacgcacaccgcccaagccatgatagaggaatgtcgagataagcagagacaggcagaacaggaacgggattatgcactctcccatcagaaaaaagtagagataccggttgaaaagccggtgctctatcaaaagtgcgggaattgtaaacagacagcttatctgaaagctaaggaaaggtatgatacacagagagaaaaactggcaggcagatataaagcaaaaacagctatatatgaagcattgatgtttctgctgatatggtattccgtatcaactactctttttcagatgatacggtcaaaaatatttatttctgattgcgtggtattctttgatacaatcgccacttttatacagaacattgcaggattgactatactggcagggaagaatgtggcacaggttagcaatggaatatccaatcctgtcgttgccggaattatatactggatgataagaatactgatttccggtggatgtctggtgggtgtgggaatacttttggcattcatcgaaataaagattgcagggctatataagaaatactgttgggatatgattaccataatggtgatactcgtaagtatggcaatagcaatctatttcgcagattggataaggacaatattaccagtcaatctactgtttctattgttattggtacaggtaatatatgtcgtgataagatggtatgtgaaaggctggcgggaaacaaggggatattactaaaacatactataccatgcctaaaactgttaaacaataaatcggcataattggtcatttcatgatgcaagataaaaagactgattatgtcgatatacagattctgtgaatgaatgaaagtggataacttgttttgtccgagcaagggaactataatgttttggtagaagtaaaaaagacaaccatttggttgagaaaaaaagatgcagaaaaacctattgacggaagaataaaaaatcaaggagtaatcatgatagaaaacaagataatattgattgaagatgataaagaaataagaggaatgataaacgattatttatcaggagaatttgaagtgacagcttttaatgatggtatgtcagctatccagaaaattacaagctatgatgaatatgcgcttgcgcttattgatcttatgttaccggatataagcgggatggagattattaagataattcgtaaagtcagcaagataccaattattattattactgctaaagacaatgatacagacaaatcattaggattgaatttgggtgctgatgattatgtggtaaaacctttttcactcattgagcttactgctagaataaaggctaacatcagacgagcaagaacctaccaggcgttaccgaataattcaattatcaaaattaaagatatagaaatcgaccctcatagtcacatggttcagcgcaaaggagtaaccatagatttaacgccaattgaatttcaaattttatacattttagcaagccatccggggcaggcttattcaaaggaaaggctatatgaactgatttggaaagaaccatattttggaaatgaaaatgtgttgaatacacacatcaatcgtcttcgcttgaaattgaagagcaatgcagaagacagtacagcctatgttaaaactttatggggcattggatataagatggaggagaaatagatgatgattttatttgtggttctttcatttgttatggtttttatattgatctggcaacagatacagcataaaaaattagtacgagaaattgattatattacaagtaggcttgatactatttctgtcatttctgaaaatggctttgtacttatacctacagataatgatagtatcaagaaattaagcgctgcacttaataagctgcttcaggatttttatacaaaaaagtcacaatttgagcagagtaaacaggcaatggcgaaagtccttacaaacatctctcacgacatccgaactccactcactgttctaaaaggaaatagtgaaatgctttccaatataacaaacacttactctgcatctgaaaatgttcatgctatggctgttaaaatagaccaaaaggctgatgatttaatctcaacaattaacgactattttacaatgtctaaaataacttctggagatttttctattaaaatgaaaaaggaaaatatatcaaggatttgccaagatacaattttggactactatgaccttcttgaacagaaacaatttgaagtcaatattcagataccggatacaccgatttttgcctatacagataacgaggcgttacaacgcattttaaaaaatctgatagacaatgccatccgacatggtggtgatggtaagtatatttctttaaggctcatcacatcaaatggaaaaaacattattgaaatagaagatcgaggagatgggatatcaccacagcagcaaaaacagatctttgaaaggaattatacaacagcccgaaaaacttccggcagtggtttggggctttcaatttcaaaatgtcttgctgaacaaattggggcagacttagaagtttatagtgtacaaaatgagcaaactattttctcaatcatcttgaaaaagttagaaaatcgttagatttatgacagagaaaagagaagtccattttgtataatggcagctataaaggaggcacacaaaatggattatattatggaaaccgtaggtttgcgaaaagcctacaaagataatattgttgtagacgatgtaaatatgcatatatctaaaggggcaatatatggctttgttggtccaaacggcgcaggaaaaagcacggttatgaaaatgattttgagtcttatccagccagatgctggagaggttcagcttttaggcgaaaaagttaccagtcacagttatgaaatattcaaaaaggttggttctattattgagaatccatacttttacgataaaatgactgccagacaaaacttagagctgcactgtgagtatatgggatttcccaacaaggaacgaatcgatgaggttttgcatttggtggacttgcagaatgtcgagaaaaaacaagtttgtcattactcgttgggtatgaaacaacgacttgctattgcaagagctattctggcaaagccagaatttttgattttagacgaaccgatcaatgctttagaccctgagggtattcgtgaaatgcgaaccctttttcaacggctaaatcaagaagatggaacaactatttttatatccagccacattctatccgaagtggatcttcttgctgatacgattggaattattcaacacggaaaactcttaacagaattacctatcgaagaaatccataagcatcaaacagattatatcagcttgcaggttgacgatgtgactcgtgttgctgcactgcttgaaaacatgagaatcacgaattttagtgtattagataaagaatttatccacatttatgattctgatatttcaggtaaagctctgtcaaaagccatcattgagaacgggattggtttggagagcatgggacgcaagcaagacacactggaagatttctttttccagcttacagaggaggaaaaatgagatgacacatttgatcaaactggaactgaaaaaatttggtattgcacaaaatattatctttatgtttgccgcaattcttttcagcatccttttcattacaatatctttatgggatagcatgacagaccccaaacaggtcaaagacacatttgaaagcacataccttgtcattggcttattgatgtcattcatttttcttgtgtactcgtcggtcttaacggcaaagctggttattggagaatataatcatcgaacaattacgattatgttttcttatcctttaaacagaataaaattgattgccagcaaattaactataatcatggtttatacagcgatttcaatgacgattggatatatctgttgtagcagttatattatatttgcggataaatcctttaatatgctggagggaacatttcaaccatcaatgctccgaacatggataccaatggcaataaccactgtgattatatgtatggtgctgtctctgtggtcatttattattggcatgatcagaaaatctgttcctgcaacaatcgttacttctttgattgttattgtgttacggcaagttattatcaccaaaaacacaaccaatcaggagtccataatgcaagttatcttagttgctattgttaccgtcattgctacactacttatctttaaaagaaaagtgcctgaactatattgattatttctatttttacaaatggtaaaagaaaaagccgtcgcaaagcagattcaatttcatgtatttatataacggcggctttgatttttaaagtcaatgtttttagtgattacacaaacagatgacaacttacatgtatgtggtagctgacgtaagtttggattattttaaaagatttccaatgaatcttccgcatctacccacatctgcatattcccatccagatataatcgtacatattcaagcggttcatcaattgcaagtgcatttaatgcacaatctgagccaggcgtagtttttaaattcttttctgcttcccaacagtcaatgcggagcatatagctcgcagaggtataaacatcaacactattacgttgtggattgtattctgcaaatattgttctcattgtatcaaatctccttatcattcaatcaatcatttcttacaaaaatcagaagcgtttcaatcagttcaccatgtcattttcattttgtgctataatgtgttatcagtttttttgcccttgtatttgcccttatcagagttcgtaaacactggtgggacgatataacacaagggaaacaataagggaaagctcacctgcgccaaacttagtgttttcaaaggcttgagagatatttgataataaaagataacaattattaaatcccttggaatacatgaaatctcaattccagtttgtagaattaagaaaatcgtaatttgtggaggtaaaatatagatgaatcaaggtagaattattgtaatcacaggtgcgccggggacaggaaaaactacaacggcatctgctgttgcaaaagaatcagatttggaaaagtctgtgcatatgcacacagatgacttttatcattatttgagtaaaggggcaataccaccgcatttgccagaatcaaatgagcaaaatttgattgtcattgaagcgtttttagaagctgcgaagcgatatgctcgtggtggatatgatgtaattgttgacggtattatcggaccgtggtttttaaagccgtggcaaagtcttgttcgggaacattatgaggtgcattatattattttaagggcaagtaaggaagaaaccttgaagcgagctgttgaacgctcaaagttagaccgaaagacaaatatcgaattggtagaaaccatgtgggagcaattttgcaatctgggaatatatgaatcgaatgttatagatacgaccacttattccattcaagaaactgtttccgcagtacaagaaaaaatcgcaagtagggcagcgttgttgtcttagattgttttggtgcaattccagtttgttagctttacatcgggtcaacttgtcccgaacttttacaactaaatacccgccgctcacacagtggcacaccgagcaggaaatctgaaaaaggtctcctgctttttttctgcccaaaatgaggtggtaaaacgccaccccatccaccaattagcgaaaggagggacacgaaatgccttgtccacacaacgaaatcacgattgttcagcgcagccagcggcagtctgcggttgccgccgctgcttaccaaagcggcgaaaagctgttctgtgaatacgaccagcaagtaaagcactacccggaaaagcgtggtatcgtccacaatgaaatcctgctcccggcaaatgctccacaggaatatgcagaccgcaatactttatggaatgccgccgaagcggtggaaaagcaatggaactcccagcttgcaaggcggtgggtgcttaccattcccagagagataccgcccgaccagtacgctgtccttgtacgggagttttgtgaacagcagtttgtttccaaaggcatgattgctgattttgccatccatgacccccatccgccgggacacaatccccacgcccatgtcctgctgaccatgcgggcaatggatgaacatggaaaatggcttcccaagagccgcaaggtttatgaccttgacgagaatggggaacggataaagctgccgtccggcaggtggaaaagccacaaggaggatacggtggactggaacgaccagaagtattgtgaaatctggcggcatgaatgggaggttatccagaaccgctatctggacgccaatgaccgcccggagcgtgtggacttgcgttcctatgccagacaggggcttgatatagtccccactgtccatgaggggactgctgtccggcagatggaaaagcgaggtatccagacgaatatcggcaacctgaaccgggaaatcagagccgccaaccgcctgatgaagtccatccggcagcttatccaaaacctcaaaggctggattaccgagctgggagaaaaacggaaggagctgcttgcacaaaaggcggcggaggaagcgacacttcttcccaatctgctgatgaagtatatggagatacgaaaggaagaacggaaggactggacaagggctggacagaaccggggaacttcacaggacttaaaggcagtcagcgaagccctgtcctatctccggcaaaaggggctttccactgtggaggacttagaagcgtttctggaatcttccgggaaatcagccgcagattaccgcaatcagatgaagccaaaggaagcccggagcaaagtgattgacgggattcttgccagccggacagactgcaaggaatgtaaggctgtctatgagaagtaccagaagatattttttaagaaaataaaggggaaattcaaacaggaacacccggaggttgcccggtatgagaaagccgctgactaccttgccaagcacccggacgataaggataaaacgaaaaatgagttgcaacaggagcaggaaacgcttctcagcgaaatcgcagagctgaaagtaccactgaccgaggtacaggaggatttgaagaagctgcgggacatccgctactgggtacggaaagccacacccggcacagaggaaagcaaagagccgcccaagaagcagcccatcaaagaagtcttgcaggataagactgacgagaaaaaagcacaaagaaccgccccggcacaggagaaacacagacaacaggatatggaactttaacaggcacttgccattttcaattagagaatgtcaggtgcttttcttattttcaaggagggatagatttgaatgtattcgaagctgtgaagcagtccgtcacaacaagacaggctgcggagtattatggaatccatgtaggtcggaacgggatggcttgctgcccgttccataacgataaaaccccaagcatgaagctggatcggcgttaccattgcttcggctgcggtgcggatggggatgtgattgattttgccgccgccctgtatgggctgggaaagaaagaagccgccgtacagctggcacaggacttcgggctttcctatgaggactggaaaccgccgggaaaggtaaaaaagcccaagacccggcagaaatccccggaggaacagtttcaggaagcaaagaatcgctgcttccgtattcttgccgattatctccatctgctgatggcatggagaacggactacgccccgcactccccggaggaagcctttcatccccggtttgtggaagccttacagaagcaagcccaagtggaatatctgctggatgtgctgctgttcggggaaacagaggaaaaagcggatttgattacggactacggaaaggatgtgatacagcttgaacagcgaatggcagaacttgcagccgcagacgcagcaagaactaaaaaacactatgaacgccatgcagccgccccagagcgttgaggaaatcaaggcggggctggaaaccaccgagaaaggcggtgtccgtcagagcatacggaactgcctgaccgtattccaacgtgaccctctgctttcaggggctatcgcatacaacatcctgactgaccgcaaggacatcataaagcccatcggttttcacagagaaagcaccgccctgaacgatacggacatgaagtatctgcttctttatctggaagaaacctacgggcttaccaatgagaaaaagattgataacgccatcgggattgtggcgaatgaaaacaagtaccatcccatccgggactatctcaatacccttgtgtgggacgggacagagcgaatccgcttctgcctgcggcactttctgggggctgacgcagacgattacacctatgaagcgttgaagctgttcctgctgggtgcaatctcacgagcctttcagccggggtgcaagtttgaaatcatgctctgtctggtaggcggtcagggggctggaaagtccaccttcttccggctgctggcagtccgggacgagtggttctccgatgatttgcggaagctggacgatgacaatgtgtaccgcaagctgcaaggtcactggattattgaaatgtcggaaatgatggcaaccgccaacgccaagagcattgaggaaatcaagtcatttttaagccggcagaaagaggtctacaagataccttatgaaacccacccggcagaccgcccccgtcagtgcgtgtttggcggcacttccaatgcccttgacttcctgccccttgaccgttccggcaaccgccgctttatcccggtcatggtgtacccggagcaggcggaagttcacattttggaggatgaagccgcttccagagcctatatcgggcagatgtgggcggaagcgatggagatttataaaagcggcaggttcaagctggctttcagccccgccatgcagcggtatctcaaagaacaccagcgggattttatgccggaggacaccaaagccgggatgatacaggcgtatcttgataaatacaccgggagcatggtctgctccaagcagctctataaggaagccttgaaccatgcttttgacgagccgaagcaatgggaaatccgggaaatcaacgagattatgaaccagtgcatttccagctggcggtacttcccaaacccaagaatgttttccgaatatggcagacaaaagggctgggagcgtgaaaacccggcaacggactccggcaacccgtctgaaaaaacgatggacggttttgtggaggtcacagaacagatggagcttccattctgaaaaggacagcccgttgcaccccctgttgttatcccgttgccgagccggttgccgggaaaaaccccttatttccgggcttttctcccttataacaaccaaaacaacaaaaaaataaaagaaaagtataaatagtaaccatcgccagattgagattgtttgcaaggtcttttgaagtccgttgccggacttcgttgccgacaccctctgtctggctattttcatgtatggaggataactgcctatggcaaaaaacaaaacagagattcatgtgaccactgtatttgacggggagcttgacgccactgatgtgttcgtcagcctgatttcccagaaatacggaaagacaaatgcaaaagaatatcttgctaaaaagaaagatataggctataatgaagatgaggttcaaaagagccagataccgtctggattgtgtgggtaaatggctatgatgaacgaaatggaatacagaacaatcggttcggcacttgccgggggttatcgtgcggcggtctattgcaggctgtcaaaggacgatgacctgcaaggcgaaagtgccagtatcgcaaaccagcgtgatatgctggaaaaatactgcgaaaagcagggatgggaggttgtggcagtctatcaggacgatggcttcacaggtcttaacatggagcgtcctgacctacagagaatgttgagagccattgagcgcaggcagatcaaccttgtcatcacgaaagacctcagccgactggggcgtaattatctgcaaaccgggcatttgattgaggactttttcccaagaaacggtgtccgctatatcgccatgaatgacggcatcgacaccctgcgggataacaacgacattgccccgttcaagaatatcctgaacgagatgtacagcaaggatatttccaagaaagtccattcctcttatcttctgaaagcgcagaaaggacagtttaccgggtgtcttgccccgtttgggtatcggaaagacccggaggacaaaaaccatctgctcattgacgaggaaaccgccccgattgtgcggctgattttcggatatgccctgaacggtcatggtccgaactatatccgcagacggctggagaaagaaaaaatcccctgccctacatggtggaaccgggaacgggggcttcgcaatacccgcaccaaatgggaaaagaaagacccagaaaacgggcggtatatgtgggacttctccgttatcaaagaccttttgatgaatcccgtctacaccggggcgattgcttcccagaaaaaggactaccgcttcaaaatcggcacgattggggaaaagaagccggaggactggattgtggtggagggacagcatgaaccgctgattgacagcatgagctttgacattgtgcagaacaagctgaaatcccgccagcgtccggggcagaccaatgaaatcagcctgtttgccggactgttaaaatgcggcgagtgtgggaagtcgctgacggtacgctacacaaacgctaaacatccccagcggatttactcctgcaagacctacaatgcctttggaaagaaccactgcacccagcaccggattgattatgacaccctttacagccatgtgctgcggaaaatccgggaatgtgccagagctgccctgatggacggggaagcggttgccgaccgcctgaccaatacctgtgaagccgagcagcgggaacagcgggaagcaatggaacgctcccttacaagggacgaggaacggattgaggttctggacaaaatggtcatgcggctttatgaggatatgattgcagggcgtatcagtgagcagaatttcaacaccatgctggaaaagacacagaccgagcagacggagcttaaaacaaaagtgtccgagggcagaaagcggctgtccgatgaagtccagcttgccaatgatgcaaaacaatgggtggaagccattcaggaatacgccaacatcacagagctggacgcagccaccctcaaccgcttaatcaaagaaatcgttgtgcatgagcgcattgacgaagataaaacaagacacatttctatcgaaattcattttaatctcaaacccatcccggaggtggaacaggtcactgcctgacctgtcccgccgggacggttctcttaacaacaccatatagattttttgtacgccgccgcccgccatcgagcagagtttttacacctaattggggatgaaacagctgatgagcggtggtggtgttatcctgatcggaacacagctgatcccgcttctgagtggattatttggttaagagaaaggagtagagatccatgttcagtcagatttttgatgcgattgaggaatggatgagggaactcttaaccgggatgatcacttccaacctggacacgatgtttactgatgtcaatcaaaagaccggtgagatcgctacccaggttggacagaccccgcaagggtggaacggcagcatattcagtatgatccggaacttatcagattccgtgatcatgccgatcgcaggtattattattacactcgtactctgctacgaattgatttctatgctgaccgagcgtaacaacatgcatgatattgatacctggatgtttttcaagtacttcgtaaaaatgtggatcgctgtgtatctggtgagtaacacatttacgatcacaatggcggtattcgatgtgggtcagcacgtagttaattctgcggccggtgttatcacaggaagtaccgccattgatatttcttcggcattgacggatctttccacaacactggaaagtatggaaatcggagaacttgttgtattggcgctggaaacccttatcgtcggcttctgtatgaagatcttgtctgtactgatcacagtgatcatgtatggacgtatgatagagatttacctatatacctcagttgcgccgattccattcgcaactatgagcaacagagaatggggacagatcggcacaaattatttcagaggactctttgccctggctttccaggcatttctgatgatggtatgcgttgcaatctatgcagtgcttgttgcaggtatccagtattcagataatctgagttcttcattatttggcgttatggcttacacagtaatcttatgctatagcctctttaagacggcatccttaagtaagtcgatatttaacgcgcactaaattacaggaaggagtgaaaatcatggcatatgtcagcgtaccgaaagatttaacgaaggtaaagaataaagtagcatttaacctgaccaaaagacagttgatctgtatcgggataggtgctgcaatgggaattccaagctatttcctcttgcgtaatgtgatgggaaacagtaatgcagcaacagtcatggtgcttttgatgttaccggcatttttatttgccatgtacgaaaaagacgggatgcatctggaagatgttctgatgcatatgatcagggtgaagtttcttcgttcacccgttagaaaatatgaaactgaaaactattatgagacagatccggaacagatcagacagtctccggatacaggaaaaccgaaaggaggaaaaacggttgcgaaaaaagaaaaataagaaaactgtcgcagataccggatacaaaaaagtagacagaaaagagaaaaagaaaaaagaaaagcaggaagagaaacgcaggcagaaaaaactgtccgtccagcagtcgattgcttataaggaaatgggaagagatggaatctgcagggtacagggaaaaacgtattctaagtgtatccgcttctatgacatcaactatcagctggctcagaacgaggacaaaaatgcaatctttgaaaactggtgcgattttctaaattactttgatgccagtattcattttcagctgagctttatcaatcataaaagcagcatgaaagaatttgaacaggtcatccggatccgtcctcaggatgatgcttttgacgatgttcgtatggaatatgccaagatgctgaaacagcagctggcgaaaggaaataatggactggtgaaatcaaaatatatcaccttttccattgaagcagataatatccgggaagcaaagccaaagctggaacgtattgagtcggatatcctgaacaacttcaagatccttggagttccggcttatccattgaatggggtagaaagactgcagattttatatgagactttcaatccagataacatgacagacttccagtttgattatggttccatgatccgtacaggactcaataccaaagattatgtggcaccgaccagttttgtattcaaggacagaaatacattccacatgggaaatactatcggagccgtctcttatctgcagatcctggcaccggagcttacggataagatgctggcagaatttctggatatcgataagaacctgatcgtcaacctgcatgtccagtctgtggatcagatgaaggcaatcaagctggtaaaaagcaaagtgacggatatcaaccgtatgaaaatcgaagaacagaaaaaagcagtccgggccggatacgatatggatatcatcccatcggatttgaatacttatggaggagaagccaaacgtcttttggaagatctgcagtcacgaaatgagcgtatgttccttgtaacagcgctctttttaaatactgcaaagacaaaacaggcactggataatgccatcttccagacggccggtattgcacagaaatataactgtgtgctgaaacgtctggattatcagcaggaagaaggattgatgagcagtgttccgttgggagtaaatcatatcccaatcaagcgggctcttacgactaccagtacagcaatctttgttccgtttacgacacaggaactttttatggcaggagaatccttatattacggattgaatgcactcagtaacaacatgattatggtggatcgtaaaaagctgaaaaacccgaatggtttgatccttggtacgcctggatccggtaaatcctttgcagcaaaaagagaaatcaccaacgctttctttgttacgaaggatgacattatcatcggagatccggagggcgagtattatccactggtccatgcacttggcggacaggtcgtacacatttcaccgaccagtaaggattatatcaatccaatggatatcaatatggattattccgatgatgacaatccacttggtgtaaaatccgattttgtcctgtccttatgtgagctgatcatgggaagcagggatggcattgaagcagaggaaaaatcagtgatcgaccgttgtcttccactggtgtatcagaagtactttgcagatccaaaaccggaaaatatgccggtccttggtgacctgtatgattgcctcagaaagcagaaagaaccccaggcccagagaattgcaacagcactggaaatctatgtaaatggatcactgaaagtattcaaccatagaaccaatgtggaactgaataaccgtattgtctgctttgatattaaggaacttggaaagcagctgaagaaaatcggaatgctcatcgtccaggatcaggtatggaacagagttacgatcaaccgcggcatcaaatccaccaggtactatatcgatgagttccaccttctgctcaaagaagaacagacagcagcttattccgtagaaatatggaagagattcagaaaatggggtggtattccaagtggtatcacccagaatatcaaagatcttcttgccagcagggaaattgaaaatatctttgagaacagtgattttatcctgatgctgaaccaggctgcaggtgacagacagatcctcgcaaaacagctgaatatttccccatatcagttgtcttatgtgacgaattccggggaaggagaaggacttcttttctatggaacaacaattattccatttaaggacaagttcgataagaacttgaagctgtacagtttgatgactacaaaaccggaagaagttgaaaaacgagagaaagaaatggaggcggaaaagcatgaaggaaattgataagatccgaatcaggcagtggaatcaggataatccttacattcagatgaaaaatctggaaaatgcacagcctggataccgtgttcatacagtcaatgatgatcatcatctgtatgaacttccgctggaaacacagaacattatccttgattgggtattctggaacttttatccggcacagaaaatctatccgcatcttaccagtgatgatctgaaagaagttttgtataaacgtacccagattcacctgtacaataatcagtttaaggaagctatgctgatcaatggtttctggccaagagatccgagtgaattgaactgggtatttcatatccaggcaagctctccggcaatcagaacgcaggcagatggttatcctggtatcccgatcattggacgccaggaactgaatgagtacagaaagaaaagttgtgccaggaggtgatgacctatagctggaaaagaatttaaaggcaaggataaaaaggtcgcaaagatgaccagggagggtttgacagaagaaaacctccgtgatggtagtgtaaaagatatcagtcacaggagccgggggcgaccggaaaataaagaagaatttgttcctgaacgggaacgaaaaaaggctgagaatgaagattcaaaatcaggaaaaggaaaacgactgcagatggagaaaatccgtaaatcttctgctcggcaggaagctgttgaggatacagttgaagttacaccggaagaaaaagtatccggatatcgaaagaaactgcatcgttatgaaaaaatcccggatgatgataataatctgaacagccaaaagaaatccattcggaagaaacagttgcaaaaacagatgaccaaagaacaggcaaaagctggaagattatcttttgatgatgaaggaaatcagatggtgaaaggtgctggcatgaaaccgggagggacagccgggaaatacattgctacacaagctgttatatctggcatgaaagcagtctcttccgaagaggaagaaacagatgaaaatgcaggtgtggaaagtgccagacttgtagagcgtgaaacagaagatgcgttacgtggtctgcgtcatgctcagatccgcagcaaacggacggatgtgaaaacccatcgcagaggttatcgtgaggctaccgtagaaaagaaactaaaatttggttctgcagaaagtatggaaggagtcaagaatgcagaaacggtaaagaaagccgaacaaaagagacatttctataaccgcttctttcagaaaaaacgatataaggatgcataccgggcagccagagccggaaaatccgctggcagtctaggtggagcaacaaccattgccggtgtcgagaacatgacggtaaaagcaaagattgccttgaaagagatcataaagcgtaatcgtgccatgttcgcaggcatcggtatttttgcgcttctttttcttgtcatagcggtatctctgggaagctgcagtgcttctatcgagggtgctggatctgtgatcggtattacaacgtatccaagttcagacgaggatatttatgctgctgaaaatcaatatgctgctttggaaagtgccttgaatcagcagatcaatgagatggaacgaagacatccaaattatgacgagtatcagtacaacattgctgagattggtcataatccataccatcttatctcgtatcttaccgcaaaatatggagactggacgtactcagatgttgaaaatgagctgcaatctctttttgaagcacaatatcatctgaatacagaaggtcgaacagaaacagtgacagaaaccagaaatgttcgagtcggagaatcattgggacaggtagtgaccagtggatattgtaactgtcgaatctgctgtggtgtatggtcaggcggaccaactgccagtggcgcatatccaacagcaaaccataccattgctgtagatgcttccaatccatttgtgccgattggcactaaggtagtaatgaatggtgtggaatacacagttgaggataccggagcctttgcaagatatggtgtgcagtttgacgtttactatgataaccatgctgcagcctctgctcatggacatcagacctgggaagcctatatcgcagatgacaatggcagtcaggaagtaacggttaccagtacaagcaccaagaagattctatacgttacactgacaaatggaagctttgatgctgtggcaagagccaatctgaatgcagaacagctgattatttacaatgcgttaaatacgacctatggaaacagaaattatctgtgggatgtaaacaatgtgaccagtggatcaggcggtaatggaatgagctatgagattccaccggaagcactgcaggatgaagaatttgcccggatgatccgagaagcggaaaaatatctgggagtaccttatgtatggggtggttactctccgtccggatttgactgctcaggattcgtatcctatgtcattaaccattgtggtaatggctggaactatggacggttgaccgcagaaggattaagaggcgtatgtacttatgtatcaccgggagaagcaaaaccaggagatctgattttcttccagggaacgtataacacatccggtgcaagccatgtgggtatctatgtcggtaacaatatgatgatccattgtggggatccgatccattactcaaatatcagcacatcctactggcagcaacacttcatgtgctttggaagactgccataaatgggtgattgaagggaggtgaaagtttgaataaaaagattaaaaaatatctggatgagattgccaagacagagaaaaagatcgcggatctgcagcaatatctcagaggtgtccaggctgcattaaagcaggaagaggacaatgagatgatcaagtgtatccgtggtatgaaaatggagaatggtcagttgtatgatcttttggatggcatccagaatggaacagttaaatttcaggtaagcagggagtctgacgatgaaggttcaggctcctttgtattcacagaagaaaataaggaggaatatcagaatggtgaaatggaagaaaatgaataagaaaatagcaggactgctgttgggagtcatgatgctttttacagcatcaaccacagcatttgcctatgtggatgaatcggcagaggcatccaaagtagagacaactcagacggaacagtcaacagacaaagaagagaaaaaggacgaggcgacaaacacaaacgaggtgctgccggaagatggaacagacaagggaactgcatttacgacacctggcaatggtgaagtcaaggatgacattaccgatgattccacaaaggaatttcttacggttacaacgaagaataacaacactttctatatcgtgatcgaccgtagtgccacatcacagaatgtctatatgttatcccagattgatgagaatgatctgtccgaatttctggataaagacagcactgctactgtcgtaacaccacagccagataaatcaaaggtagtgctggatgaaacaaataatgaggatgtagacaaggaagctaccgttgatccggagaaaacagtatctacaaaaaccaatatgggtgcaatggcaactatcctgatcctggctctcggcggtgtggcagcatactactacttcaagatctataagcctaaaaaagaggaagatgaggatgatcagccggaaggtttggaaacagatggactggaagaaatttcggatgaggaagagtctgaagacgaagattttgaagaaaatgaaaaataagtaaacttttttagcggagggggctgtaaaacatgctctctccgtttcgttatatgaaggaggttatacatcatgtatttagtaattgcagaaaaaccaagtgtatcaagagcaatcgcagaggtaattggagcacaggaacgagaagacggatatttaagaggaaccgactgtatggtcagctggtgtttcggacatctggcagaatatgtttcaccggatgtctacgatgagaaatttagccagtggagatatgaagatctcccgatcatcccgaaagactggaaagttacagtctcagaagataagaaagatcagttctatatcttaaaaagactgctcaacagtccggaaattgaatacgtcgtaaatgcctgtgatgccggacgtgaaggagaattaatcttcaaacatgtctatgacttatccggaagtaaaaagccggtgaaacgattatggatcagttctctggaagattccgcaatccttgatggaatgcagcatctgagatccgcggaggaataccgacatctggccgaagctgctgtatgccgttctcaggctgactggctggtaggaatgaatgcaaccagagcttacaccacaaagtacttcaaaaagctgacagttggaagggttcagacaccgacacttgccatgttggtggaacgtgccggacagatcagcaatttccagaaagaaaagtatttcaatgtggaactcgattgtgatggaattccggctataaagccaaaaatctttgatccggatgaggcggaacagttaagaagcagatgccagggaagtgaagctagtatcactgcagtaaaagaaaccgaaaagaaagtaaaagcaccaaagctttatgatctgacaacactgcagagagaggcaaaccgtatctatggaatgacagcaaaacagacactggatacctcccagagcctgtacgaaaagaagctgatcacttatccaagaacggacagccagtatctgaccgaagatatggagcagactgcaagaaatgtggttcgtcagatttatgagaaatatcagctgacaggtccttttgatcagccggagcagccagatgtgaagaaagtcatgaataacagcaaagtgacagatcaccatgcaatcatcccaacgctggagcttgcatcctgccatctggatgaactgaaatcctgggaagaaaagattctgttcctgatcgcagttcatacggtcatggcaatgagtaaggatcacatttaccaggagacagagattgaagtggaatgccagggagaaatcttcaaggcaaaaggaaaaactgtcctgcaggatggatggaaaatctttgaaaactgcttcaagaataaggaccgcatggcaatcgcagatccggatcaggaaatgaaagagaggattccgaaagtaacccagggacagactttctatgctgtagatgcagaaaagacagaacattttacatcgccaccaaaaccatacagcgaagatactctccttgcggcaatggaaacagctggaaataaggaattcgatgaagatacggaaaagaaaggattaggaactccggcaacaagagccggtatcatcgagaaactgatctattcccaatatgctacccgaaaaggaaaacagattcttccaacagatgatggaaaagtccttgttgagatcctgccagacttcctgaaatctgcaagtatgactgcagaatgggaaaaccagttgcttttgatggagcatggagagattgcaccggaacagtttatgactgggatcaaaaacatgctgaccatgatgctgaatggatgcgatgcgatttccgaagaagaaacaagaagatttcagaccagagaaagcattggaacctgtccggtatgtggaagcctggtatatgaaagtaaaaccaacttctattgcagcaaccatgattgtcactttgctctctggaaagacaaccgctatctgcagagcatggaaaaaaacatggataaaaagatggctgcagaacttctgaaaagtggatgtgtgcatgtaaaagacctgtattccagaaagaagaatatgtactttgaggcagatcttcatatggatgcagatgaaaccggaaaggtgaatttttctttatcctttcccaaaaagaaaccaaaaaacaaaagcaaaaagaaataagaaaacagattagaggaggaaacgaagaatgaattttaatgaatttgtaaatgaagtaaaggacaatatcagactctttttaccaaaggattatgagaatgcagaagtatcaacgatggagtgtcagaaactgaaccgtgcctatacgggactgatggtgagaaaagaaggtgagatgcttaccccgacgatcaatcttaaccagctgtatgaagcatataaagcacagcctggtgtaacaatggaaactgtatgcagaaagattgcagatatagtcattgaggcaccgatacaggttgatctgaaatccattttaaattatgaagatgtgaaggacaagctgtttatccgtgtatcatcagccgaagcaaataaggaagtcctcgaaaatgcgccacaccagctgaaggaagatcttgcaatcacctatcatgtggcagtaggcaaggatcaggatggattaagttccatgtttatcaagaatgatttgcttgaacagtatggaatctctgcagaacagcttcatgaagatgctatgaaaagttcaccgcgtgtcatggccccggaggtatcaagtataggtgcattgatagatgaaatgtaccagaaaaatattctcatgctgacaccggatgaacgtgaaatgttgcaggaaacattgcaggaatcaagcgagatgccgacattctttgttgttacgaatacagaaagaattgatggagccggtgtgatcttttatccggaattcatggataacatgggggaacttctgggaaatgatttcttcattttgccatcatccatccatgaaatgctggtcttgccagatgacgggcaagtggatgcagaaatgttaagagatatggtaaaagaagtcaatgccactcaggtagcccctgcagaacgccttaccaatgatgtatatcactttgatacaaaggatcatgtctttgaaaaggcagatagattcacagaacgtcagaaagaaaaagaagcacaggctgcaaaaacagagaaagcaggaaaagaacagccggatcagaaaccgaaaacaaagaaacatgatatggaactctaatatcaagcatgaaacctgttaaatgagcaaacgccctgcggcataaggaaatgtcgtggggcattttgaaaaggagaagattatgacgaaagagaacattaaaacaaatacaagcttaagatacagccagtatcaaaaaagattattacacacattttcgtttgaaaaattgaagaaacaaattgagacgttacatgatcaggaatttattataaatgtgccgattggaggtgttgctgatggcagataaattagaacaggtagcaattcgtatggtggaacagccaccactttatagtaatgaacctatgaataatccagatgtagcaattcgtgttatgaatgaatttctttcccagatggatcgggaactcttttgtattgttaatttacaggcagatttaacaccgatcaatatgaatatcgtatctgtaggatcgctgaatgaagcattaattaatccaagagaaatatttaagagtgcaattctttcgaatgctcattcaatgatgctcattcataatcatccgtccggaaatctgacaccatctacatcggatatccagactacagcaagaatgcaggaattaggggaattgatggggatttcattggttgatcacatcattacaggacggaatgggaattactattcctttcgaaataaaggagaatttccagatagcagggttcgtttttctactcgtgttgaagatattgatctgactaaaggaatggtgactgaagccaccgcaccctatgaagaagtaacagatacaaaagaaaagggtgacgtaagagatattccaacagtgcagacagcaacaattccattaccggttcagggaaaagatatggacagcattatgcagtcactggaatccggtgtggaagaactttttacaagtaaccgctatcaggaatttcttaaaaccatggcaaagtttcacaattattcctttaataatacaatgctgatcgccatgcagcgaccggatgccacacttgttaccagctacaaaaactggcagtccatgggtagacaggtcatgaaaggcgaaaaaggaattacaatcattgcaccggcaccatataagaaaatgaaggaaaaagaggttctggatgaaaatcagcgaccaatcatgggaactgatggaaaacctaagactgaaaaagtggaagttacagttccacattttaaagcaattaccgtctttgatattgctcagacatccggggaaccaatccagacactagcaccggaattactgactgcagctgtacaggattttgattctttcatgcaggctattcagaaaatatccccagtgccgattcgattcgatgagatcgatggcaatgccaatggatattatcacaatgcagacaaggaaatcgtgatcaaaaaagggctcagtgaaagtcagaccttaaagactactattcatgaaacagcccatgctaaactgcatgacaaggaaatcatggaaagcctgggtgtagaaaaagaccgtctgacaaaagaggttgaagcagaatccgttgcttactgtgtgtgttcttcctttggtttggatacatcggattacagttttccttatattgcaggttggagcagcagccgggaaatgaaggaaatgaaagcatctatggatgtgatccgcaagacagccggtgaaatgatcgatcagcttacagaagaactggaaatcattcttgaagaaaaacaaaaaacagaattacatgaaaaatacggcattctggtagatgcactggaagcagccggataccgctatgattatcgggaaagcaaaccgggacatattgtactggcaccggatgggacacatgaaattgctgggtatttgcagtttgaatcatgggaagatatcaaagattggctggaagatacgattgcagaaggaacggatatttcggaaagagttgatcgggctttgtatccatttaagtttgattataccctagaggaagaaatgttcagagggaatggtgaccgctatgcgatttaccatgtggatgaaggcacaccgggaaaacaacatttatttatgaatatgacaatggtcaaagaagatggcattacaatcgatgcggacaattataaatgtgtctattctggcagattacatgaaaatgaaaagctggatgatttgtacgctatgttcaacgataatccaccggcagattataaagcacattctatgtcggtcagtgatgttatcattacaaaccgtggtggggatatgcaggcatattacgtggatcgatttggatttgcagaacttccagactttgcagcacaaagagaaaaaatactcgatattgtaccggaaatagaaaatgtggattatgaaaatgatcttacatgtatcagcttttatgcggctgaatgtgctgaatttcctgtaatgggtgaagtacattatgacctgacattaccagaagccttggaagcttatgagaaaatcccatcagaacgtatgcatggactgaaatgtgttggctttgatctgaaagacggaagtgattatgaaggaatgcagagtctgatgattgaaggaaaaatacagaaagaatttttgaattcgattcctggatttagagaaaattcttatgtgcaaaatgcaatcagtcgtgtggaaaaatacttggaagaaagacatccaaatgtggaaaatcctctggaatccaataagaaagtggataacgaaaaaaatataagcgaagaaaaaaacgagaaggagctgaatatacagatgaaaccaataccgaaaaagaaaaggggggaaatgagcctatgagaaatgtaaacctggaagaaaacgaactgactattactgctatcttccagcagcacacaaagaaagaaacaatccaaacactgaaagaagctttggaagttttggaacaggaagaaagtgatcctgagaatgatgaaataattgagatcatcaattctacagttggaaaattacatcagatcgaagacaaatactactattctctggatctgaattattatctgaataacttggaggatgatgcctatgaagcttaatcaatttgcagtctaccgagtagatcagcagacagcaggaaaagcactgtggcatctgccatatcaagaggcaagacagcagaatgtgtcgattactgtcgaaaattaccgattaatctcgattcatgaaatgcaggaaaatgaaaaagtcgctgacatctggaaacggacgaaaaatcaatgcgaagtcagtgacgtgctcgtattgaacaagaatggagaaatcagctgctactatgtagatgagaactatccacagtatctggccggatttattcgtatcaacacatccggtgcactgatcactatggaaactgagaattatcagattgatgggaaaaaggggaactggattgcaacagacaccgtcattattgatggaaaacagttttatttgatggaacatcaggtataccgagatcaggcccagggtgttatcctggatgcttatggaaaaatggttgtcgaagaatgtaagaaattcgatgaaaagacaaaacaaaagattcatgattacatccaacagcaggtaccgctaaatccggtcgaacagctaaaacaagatggtaaaatccgtctggaacattaccagaaattctaccagaacggcacttatgaacgaagcagagaatctggtacagaagctaactatgatatggtggacggtctggtgaataatcagaagaagaacctggaaaaaatttctgatgcacgcaacaacaaacagacgtcccgaaatcaacaaaataataaacctaagaaacgaaggtccgtaatcaaacgactgcatcagaaacagattgccattgctcgccggtccggaaagccgataccaaagtacctggatcaggaaatggaaagaaagcggggatagaatatgcgaaggttaaagtgtgaaaaagaaacgattattctgactaatgaagatgatggattctatgatgtgtataccttcaatcagagcttgcagaaacggttgaggtcttttgcggagaagtatccggatgattgctggttgaaaggatcttcggaggatggtagtgaaacgtatatgattaaaaaagggcggttatcattgaatttaagaccaccctattccaaggatagaattcataaagcaaccgaacgaattattgaagaacagaaagagcaatcgaaggattcatagaatgcgatttaagagaaaaaagcctcatgaccatgagaaaaaatgaaagcaaaatacgttagctgataaagtgtataggctcaaaagggaaagtgcccttttgggcctttttaatttaaaatagttctaaagaacaagttaacaatctgtagattctgtatgttttaaagatcaatcgttatactaattttagaccgaattatcgttctaaaggaggtgtcacaatggatttaaaggcggttggtcagagaataaaagctgcaagggaagctaagaatcttacacaagaagaattggcaggactggtaaacttgagtccaactcatgtaagtgttatagagagaggactgaaagtaacaaaacttgatacttttattgcgattgcaaatgcattagatgtttcagcagatacactattgattgatgttgtgacacattcggttagcggcgttacgaatgaattatctgaaatgatagagaaactacctaaagaaaagcaacagagaattatcaatgcagtgagagcattggtggaataaatacgtgaataagaagatggaagggcttattgctcttcttttttatttggtttaacgtgaaaatatgatatagtagttctaaagacttatatatgattctgaggaacttgataaaatgaagaaaaataatataacacttgtatttgttgctatcgttttttcgattattgttggaatgataattggaaaaagcttattaaagtataaagaaggtgagccagatgtagttggcagtttttctatgaatagagatgaaaatcttacagtagttgctaacagaaaaaatatttctgataaagaagcatttgcaagactgcttttaaaaatgtataaagagaattcatttcattcaataaaattttctacagattatggatatgcaaccagccttgatatgaccgtatattcttggaaagaagatatcgaaaatggcgaatccattatgcaaatagaatttagaccaattgaatatggaaaagattatgatcttgttcataatccggataaatatgtgctttttatcgatggaacagaaataaaatgaaatatatagatatgcagataaagcgcagaaaaagaggattgctcaacacaggaggatattttcaattaccctcaaaatgataaaagcgaggcagcggaaaatccgttgcctcatttcagtattatgacaattaatctagttccgcccctaactcatacctccaatattctgccgcttcatactctctaggttctgagagtactggtacggtaaagagttcaaccggaacaccgagtgttgatgcgaagagtttcgtaagatcctcttttggtgttcggacatcgccttcatattgagcaatccggacatcagcacagctgtcgggaaatccaacagctatgccaagttctttctgggtgagatgatttttctgtcttaagtgttttaattttcttccaaatgtaatcatagtattattctcctgtacttccaaaagccccggttcctcgttcattaccaaggtccaggacaaaatctgcgatcacgaccggtgtaatcaccagctgaccgacgcgtgtgtctttatgaatggtctgagaagatgtgcttacgttgctgataatggcatggatctcaccacggtaaccggagtcgatcggtggaagctcgcataccagtccttttgctgccatgctgcttcgtggaaagacatatccggcaaatccatcggggatgatgagaccaaatccaagtggaattcttgcaacctcacctggttttaatacgcaatcataaggcatgaatacatcagcaccggcatcattttcatgtggccggaagggatgatgatctgctttcagaccaaagtcaatcagtttaatctttatggctgctcacctcccttctgatgagcaatggataatctgcttttaagatatctgacggtatccaaagttttgaaataggattctggcaggacatctgtttttccatacagcttcctctctgacagaatggaccggtcagatccggtgcaaaaagaatcgggcttaatttgtacaatctctgccagatctgtagcatcacaatccttgtttcatccgtatttcttctgcaggttctctgactgatcatatgcttccactggtaaggcgttgcactgatgatcagtacgtttcgaagtccctgcggtgtggcatatccggctgaatcatgatcaatgcctaaggtacagagttctgtatagtgctccagatctgactgacagctttttttgtaaatatcctggatttctttatctgctttcatgattccatatggaatagcaaatgcagcatgaccggaataattgctgtactgcagagatgcactcatgtactttacttcgttctgatgtcttgtgatctgtgccaggaagcgtctgcttgcaccaacaacagctacggtaatgaccatgaatttctgcacggttggatgcggaagccctgcaatgttttctacagtcttctgactgtaggattgacggtaaagatccatcagatctgccatgttctggatcgtatgaccgtgttgtgtgagtctggcagcaaagaccatattctgttctgcttcccggattccatagcagtttaagatagctgtttcaatgtgatccataggcctgttcctcctttaccagagcttttaaaaggatcagataattgatgcagtctgtgattttttcatcccactgttccatgtcaaaatgtaacagagtggaataacacatatcgtaaagggatacgacatgtttcgacatcataccggccagtgctgcttttggatcgcagttttgtaaggcggcagcaatcttgaatgcactgaggcggtcaatattgtcaccggtatattctttctttttatgtgccagaatatcggcacactttctcatctgaagttcaaatacaatattaaattcttcttgtgtcatgtgatagttcctcctttgttttgtgatggttatcgttcgagatccttggtttttgatcttactggttccggaatctgcatctgaagaatggcatcaacattctgatcggcagtatccagatcttttagtttttctttcaagctgcttattgcttcttcttcggaagctatctgctgttgcagtttttctttttgtaaagtcaaggtttttaggcttgtcatctttccatcctgataaaaggatctcagccaatctctggcttcttcatatttctgaatttccttcgcatgttctttccggtactttcctttgtactttgcatttgaaaattgggaataaacctccttagttgcatagtactgtccggtataacggatctgatcgttgaggatccttagatcagaccgatgctgagcaaactgtgtctgcatttcttttagttcctgctttgatgcaagcagtgtatttttcagatctgactgcgtatcaaatccatgttcctgtacatagataatggtatttgccatttgctgcaggttagaaagttttacccgatgagcataagccgggctctgcattgctttcacatttgtctggagatttacaaccaggcgcaggtgagatctgacgtagagaatggtcaatggatccttgcgtaagaaggtctgttccaggtgttcttttccatatcgtgttcccagtgcacgttcagtaatccgcttctgtcgatcaggatgaagatagctgtatctgccccgatgatcaatcacagaaatctgaaattgttccagaagtttagattggaattcatcaaaactattggaagtggcagcgcattcatcaatcgcatttcgcaaatattctttctgtgtaaggaacacggtggatgttggtttgagaccatcttcgatgatcttctgattgatctcatccagtttttgctggccgtgtttctgtgccatatactctttctgagtgatttttttctcagccggagcaagaagatttatctggtgaagcccttcctgttggcaccgatccatgacggttttcttaaaagtgttcatgaatttgtcagtggaacgatgcttgtaaccggcggcttcctcatgtggtttatccatataaagctgccttttcactgcagtcttccgcacactattgataacgatgtgagtatggatatttccggattcattgtggccatcggtatgagtaaccatcagagcctgatatccgggaaacatctgctttgcaagatccaaactgattgcctgtgctctttcaccggtaagtctgttttctgtaacatcggctggatcgtagctgataatgtagtggtgacttttgatctcttcacgtttcttatttttgtgaaaatgagcatttgtcagttcgcattccttgtcaaaagacatcggatcacagttcagtccatccatataaaactcttttcgcaggatgcttcgtccggattcatctacaatctttttcccggttttttcatcatgttcaaacagaagataattgatagcagccgagtaatttgcatttctgcttttaatgtgttttacgattgccattcataccacctgccagtttcagtacctcttttcttaataggaataagtccgtgatgcactgatgaatctcattttctatagcacgtgactgactgccaccactgttaaaatgcttggcaatctgattgagattcgatccaatctttccatattcactgaccagttttctgagatcgttcatgtctgcaacaactttaatctgatgattgatttgcttctcaagcagaagttttctcagatattcagatcgtgagattgaaaaacaagtagctccttgatccagcaaattgagttcgacatctgtcagtcgtactgcaacaaaatgtctgtgatttagttctttatctttgttttttgttctcatactcctccttccgttgctactattccgcccactgggagtccacgtatttcaatatcggctgtcccttccgatattagaaatagtgctgtgaacacctttaggtgaaaccaacagacaagtgaaacgtctgttatgaagagggtatggggagatccccatcaagataaaacccataggagaacaggatgccaagtggcaatactgttaaacacgggtggatcttgctctgtatgtgtacccctctatataacgaaacgctgagagcctgttttacagtgggggaaaagaaaaaatatcaaaaaaatgatgattaatggtgagcttgtgatagaatgaaaaaaagagaaaagcataagtgttggatatatgcttcgcattgattgctggggagctgaaaaagatttaaaaaccacatatggatcagaatgtgcgcttacttcattggctgtggatgagcctttagaatatgcaagattatatctcgatggcaatttacagatgtggatagattcagaagattcacttgaattatagaacaagaataacgggtagaaaacttctgatgcccattttacaaggggttcgagttttttatgtctgctggcgctatttctctgctggagtactattttcgggataatggcgaaaggctttagcggtatagttagaagcaccgtttccatattttgtattggttatggtttttatataatcgctggaataatagtcaattgtagagcaaatgaaatagacacaggggattaaggaagagttgaaggcagataaacagatggaatgggtagcaaataaatactatacaagagtgtgaaaagggaattttgaataaggagatgatttggcaataaggtgcagtaatctggtggaaagcaagtctgaaaatggcttgctttttgctttacaatgtggttagttgatgtatataattatgataaagagataaaattgatttttatattttggttcgatattgtgatgcagtttttatcccaaaaagagtaaaaatcgaattatccgcataaacacagggattttaagcaatatgaaacaaaaaataaaagaattttaccactaatttactacgaatgaaagaaccttgatacgacagagaaaacagcataaataaaggcaaaattggcatttcatacagaatatgagatgtcttttttgttgctgtaatacagtataactattctttttctgcttgattattaatcattttttaggacatgaattgtcaagagcttgttgcgtagcaatgtttacactcttgataatttatggaataaaaaatattctgacagatactagaaaagtgatgactactcaattttctaatgatataatatgataaataataatagataaacttgaagtgattaaggaagtgtatgccatgaaaaaatttttgaaaataatgttaatcataattggagcgatttctttgatttttgtagctctgatagggattgggttatttgttgatgttgaatatgatgaccatattgaaaatggtcgttatacttatgttccggaagaagaaaataaagataatgaatacgtggaatttacgataaatgattatgataaaaataatgccaagcttgtatattatgacacgattgaagaagctattcaactttccactttgaatgctgaaaatgaggaactttcggttcctgctgattttcttaatcatgttgatgaaaccttgcatatatggcaaggcaaaaaatatgatacgattttctatcgggctggaaatgataacgatgatattcaaggcttagtaatggctcgttgtaaaaagcagatacagaatgggcatacacaatacgcatttataaatgctacaccggttacaacgaaacgagatagaattttgttagatgatattacagagcttattcactcttctttgaaattaagtgatttccaacaagacttaaaccccgattatccaagcaagcgttttgtttacggctatgcacatgataaagaaatctattcattggaagtagaaggacaaaaaccggacggtgtaattgaaatcaatgtatatgacagagtcatgtatctatggtattacaatgacttacaaagtaacaaaagaggtgactgtttaagctattcggtagatgtacctaaataaaatgacatttttacataatactatattattagttaggcagacggagtgatccagacacggtggcaggaaaatctttcagatttttctgccatgtcttgcaagtggctggtttacttcgtctgtgagcgagcctgtggcgagcgaagattaagcccccgttatctaacaaggggggcacaaaaaacaaaagacactatacactaacaggcggaaaacgctgtatttacaaggcaaaaccgcattttataagatgtgatataaaaagtatctatttcacaaaagaaaaacaataaatttaaacattataatattttaatttttgtggtaatgatatgcaaactttttaggagggaagatatggattgtaaaatgactgatattattgctattatttcaagtatcattgctattggttattcaatttattccataattactaaaagttatattcgtcaatacaaccttgaaaaatttgaacatttttctttaaatcagaagaaagtttgtattgttttcaattttattatgacacttataattgggataagtggggtgtatatattgctattatacttattctaatgggattgaaagcatttatgtagcaaatagcaaaattttataagtgaaacgaggtactctatggaaaaaaaggaacttatcaaactatatttacaaaatgtggataaaatgtttggatatgccaacatgaacgcatatattgatgagcgattaaagaagtatacgaaatactgtcaaagtaaaaagccagaagaacagattattatatggctgaaattattgcatgaaaatttcggaaaaaagattgtttatttaggaagttacttagcattacaagaaaaggatatgagctatttaaataatgcgttcaattcggcagtaacatggggacaactcacaataacaaacagcggttgcgaccattccattcacgcttggaatattttaccacatatattctgtgcaaaccgctttcgtgacattgaaaaaatatttccaaaagaaaacggacttagtaagaatgcagatttatgagtggttataagaagtatctgccaaaaagaaaacaccgataaagcctgtaaaatagggatatatcggtgttataagaacttatgaaaagataattagaaatttattttatgttttaatggacaaaacaattgtcaaggatggatggctatatagaaatggatttttaaggaagaactgtaaaataagattaacggatattacccagatgaaaagaaaaaagaatttatttggagaagctcttattttatataaaaatcagaaaaaaatcgctaaaatttctgcccgaaatagaaatgtggactggctgcaagtaaagattgcagaaataaaaaaggataagaagaaattagaacgtaaaaaatgaaaaatgtgaatcatatagggagattgagtttatggataatgtcattagattaagtaaatttgtaaaaaatttaggaatagtaacaacagttctttttttaataatcgtactggtaacatttgttacaggaaatatgggggttgcgatatgttttatgccttttgtatttttaggtattgctttaattttggcatacaagaaacaaataattgtagtaaatgaagatgaaattgtatttagctatctggttaagaaaactcagcatataaaatataatgatattcgttgtattttaatgattccattaaatggtagaacagatgtcatattaattgataagatgtacaatagacttgttactctggagcaagtgtatgtaaattatgatattttatatgatacacttataaaacatgaaatagatcttgtggattttggtgagttagttgaacagaacaaagatgtatcaaagtatgtacctgctttaaactggatagaaaagaatttctataaatctatatgtaatgagaatacaactatcaaaaatatgtcaaaaacaatagaaaaagaaaagcgtaaaaaaacaaagcaatttttaaaagctttaggttggattctaataattgctgatgcggtagcattttttattggtggcaaaacaatgttagttatatttataatggttttgatgattacatatgcagtgtatataaaatattatccatattatgagtggggacaaatacaatccttctatgatgatcgttcttgtcaaacaggaattgtaattatgttttaaaataaggaatattgtatctcttgcttccgtatgcagaaagattacatcggtacagagaaatgtggtagtgatacaccaaagaacacaggcgaaaccttatatctcggttccacaagtagcgaatctttcaaaagagagagatgggtaaaacttcgctgtttatataatagtaggggacgatgttttatcccctgctattatacgttttttagcatgttttcaccaatattgcttggtacctaaccgatttttcaaataacatctgattccaagatatactccctgagaaagtacgaaaagcaatagaagatttacggaaagtgcttttttaattgcttctccaaaataaatgatgacagcagtacttgtcagtatcatcagtagagtaataacatcccaacagtttttcttatataattctataacctttatttctatcagtatcgccagtatccctgtccctgccacacatattccgacaaccaatatcagaaataaccaatataccattccggctataaaaggatttggaatttttgtgctaatctgtgccacagattgcccggcatcaattgtccaaccgataaaagtttgtaggaatgacgctgcatcatggaagaatgatttacaatcggaaaggaacacatcggactgtactgcctgaaaaagagtggttgtcagcgaataccatgcaagaaggaacaaggttgtttggaacattaccgtttttgctttatactgtccggcaagtcgctctttttgtgttccgtatttcgctttttcattctgataggctgtccggtcacaggattcacatttttcatagagtaccggcttttctaccggtatctctacgattttctgatgtgtccgggcataatcccgttgttgtgttaaacagcgtattttattttgatattccccgatcatgacgtttgcgcttcgcagcttctctttctcgttccgcaatgctctgtctgccagcttcaagtcgttctttaatgcttgaatattcccggctctgttctctttgtttaatttctcgttcaagatcagagattcgttgagctgcgtcttcagttccacgataagctggtctttctgttccagttcttcttgtatctcctcggtcaggagcagaagctcttccaactgttcggcgttctttaattctctggattcgttcatctatatcacgtcctttctctatctgctgttccagttcagcaattcggtgttatcctctgctgatttggtcgtttcaatcaatacgctacattcttccatcgtaattcagccctttctttttaattttgaatatgaaaaaagcagtcgatcataaatgaaaggctgctttaaatcatatcctttattgctttgtgtggagatttaactgattgtctatgtcccgtccggcatacattactctaagtattgttacaacttttttatcgctgtctggaatataaagtaccacataattgtctactggtaatacacgaagtccacgacttttccacggttctttttcatattttcgataacgctccggcatcgtatccagacttaatatctgttcttccagacggtcaagctgtccgcttgcattttccggcgattgtaattcaaaagaaatatattcaaaaatccctctcaaatcactgtcagcctgttcggataattctacttcatatatcataagccataatccttgcgaatgtcagcaaatgctttcttcgcattttttgtccgtccagcctgcatatccgcatatcctttctccaattcttcattgaactctgcttctgataatgtgctgatatcaacaggtctgtcagatggtatttttacttcaaacggaagtcctctctgtaagataatctgtttataaaacatattgatagcactggaagcagggataccaagtgtagacaggatactttctgctttttctttgacatctggttcaatccttgcatataaatttgctgattttgtagccatataaaacatctcctttcgtgagtagtatttccatctatctttattatatgcaaatgtccgcacaatagcaatactaattttatgctccaataatcttattgaataactgtaacaatacatcttttacgccggacgcattgaatacaagaccaacggctactaaggcaactaccaagaatccgataagtttggaaaactcacgcttacaggataatcgaactactgcatactaaccgccacagggaactcctaatcccttgctcatgaggggaagaatagtttatcatattgtaaaaaaatataaaaaaatataaaaagtttttgtgtttttaaatgatttgttaaggttagttgtttatatatagagaagaataattaagagaaaagtgatggatatgatacaagactggatgataataaacaaaattaagatgggagatcctgatgcatgggatattttagtacataaatattatgatagtgtgtatttttattgtgttcgcagatgttatggagactgcgatatagcttctgatttaacacaggatatttttttaaaattggtagaaagtttacctagataccgattcataggaaaatttcaaaattatctatacactatggctgtcaatacttgcaataattatttgaaaaaaagacatattgagcaaatagaactcacagataattttacaactgatttagacacttcattgattgatgaaatattacatgatgagagaaaagaaacggttcaaaaagcacttgatttacttcctgaaatacaacgagaggttgtgatactacggtattatcacgatttaaaggtaaaagatattgcgacaattactggcgtgggggtatctactgtacagtcacgtatttatcaaggccttagaaaattagaaaaagttttagaaagagaggaattttatgatggataaaaaagatattatatcgaaattggctggttataaattagaaggtgatatagaaggacgtgaaaaaaccatcgaattaggatatgaaataatgattagacttgaaatgagtcgacattcttactttgagctattcctgtcaacttttcgcttcatacatgttcatacttggataattcaattattcatctttctatcagggataactatggcattaaattttaaaaatttacagccgataagtgaaataatgttatgcattacaggtgtaatattcatttcggctttattttttttagatgaattattcaaaagttttactacaggaatgtgggaattggaacagacattcaaatatgatttgcgacaacatattatgatgaaattattgatttttggcattattgatatggtaattgttattttgctttctcttatgactaaatctatagtatctttgcctttgtatcagatattagtctatgtacttgttccatacaatattgtttgcattattttattttcgcttataactatatggagaaagcaattacataattatttcctatggtgtatatcgggaagtatttgtgtcgcagttattttaattgcaaatatctttaaaatatatgaaatccgaatgctttattggggaatagcatatttcattacaacgacaatattagggattatcttatattctcaaactaaaataatcaaatgggaggtagcttcagtatggaattaactattaataatataacaaaacaatatgggaatgtaactgtgcttgatgatgtgtcgtatcgatttactcctggaatttacggaatattaggtgctaatggggcgggtaaaacaactttatttcgtattatttgtggactgatgagagcaaattgtggaaatatacaatatgaccataaagatattgctctgcaagcagaatattatcgctcgattcttggattcttaccacaagattttcgatactatcctgattttacaggattaaattttatgatgtatatcgcttcattgaaaggcttaaatgggaaaatagcaaaaaagagatgtttagatttattgattcaggttggcttagatgatgtgaaaaataaaaaaatcagaaagtattctggcggaatgaaacagagactaggtatcgctcaagcaatgattaataatccggaaattttaatattagatgaacctacggtagggctcgatcccaaagagcgagttaaatttagaaaactgataagttcgtttgcatcagaaaaaatagtattattgtctacacatattgtatcagatatagaatatatagcagatgaaatcattattctaaaaaaaggtagaattgaaaatacaggcacaataagatatttgttgaaagatattaacaagtgtgtatgggaatgcctggttccagaaaaagaagtaaatcgaattgagcaagtatatacagtaagtaatcgtaaatatggagaagacggagttgttcttcgacttatttcaagggaaaaaccttttgcaaatgcgaaacaagttgatccggttttagaagatttgtatttgttttattttagagagggggaatgagagtatgacatcgctaattaagtttgaacttgggaaaatattgagaaaccgaactgtatttggtgggattgttgtaggatgcttagtccttctggggattttttttgttgggtatcactattcacagctatcaatgagtgaagcgagtaataagaaaaaggggtttgaaaagagcctcgatgtaataatagatgaaaaatattctggagagtttacagatgaaaaagttaaaatgattctgtctgattctatgaataatttccaagagaatgaagagcaaaaagttgttaataagcctttttatccattttattgggaaatgggagatacttttttttcaaaagatgccgaaaatgtttattcagaaatgattgaacaggttaataaaggccaaagattaacaatagaagacgtggatttatattcattggacgaggttggatttaaaaaatttgatactcctttgacattaggaaattatgttccatggacagacttatatcgagtacttggatatatatatgctcttttgtccataattacaatattggtatcttccatagtgttttcagatgataattctaaaaatatcaatcagattctgttagttacaaaatatggaagaaacaaaatgatatttgctaaattgattgcgacaagtattattacagtgagtttatttattatttttcaattggtcaacataggtgttttctctacaatgtatgatatgagcggatggaattcagacatacaaacaaatttgtcgttgggattatttgacttccctttgcaatataaccatattcaaatatactttttaattcttgtcatgcaattagttggtattggatttgttgagagtgtaacattgttaatatcagctcttatgcattcatctatgtcagtattagctgtttcattaggggtatatatattaccattattgctggtgcaaatgataaaaacaggggtaggtaacaaaattttgtatttgtttccaataaataatttgaatgtacaaaatatattaggtattctatattcaaaagatgcttttttcttccattccttcttcattaatataggatttatatttatttttcagctcttaatacgagtagggatgcaactatattgctttatttatattaaacattggaagttttaatgattttttcaatgaaaatgcaattgaagaaaaaatatgatatcatgtgagtaacaaatcgggattgaccgagttctttgagtgagatacacttcttggacgaagggaaggaagaagaaaaaagtactttagaggtattatggaatgagtaataaattggttaagcaccaagaaccaaaagaaatattaactggaaatcaaaagaaaattttgttttggatttgtttcattattttaagtatagctttcattacagtctggataaatatacttttgacatctaaagcatttaatacacaaatggaagagatggtactgggagaagattactatatggaggatattgtgattacaggtaaaagggctgaagctgcttcggctgatacgatatctcggaattatttcttctactacaacaatggaaaagtgaatgattatcacaagcgaatgcaagtaccgggatttgtatattcggaatataatgtaggagattccatagctgcatataccacagaccatgttagttattcttattacaagtatgggattcttccggatacagagtatacaaacaatgaattaatgaaagtggctggcgtattgcttggaattggaatatttttattggctttgtttggggtattaagtaagaaaatgaattacaagaagtaaccaacttcccgtttattgggaagtcgcagagaacgaaaaatcggtatttgtggggtggtgaatatgaaaaagaaaattttaaaagcagttttaggtattcttatttgttgggggatttttgttgctattgagggatttcgtttgattggaagcactgacccaggaaaatgtccgcttataacacttggaagcacacaaactgcggatgaaattgctgattatggaagtttaggattttcacaaacatatcatctgacaaacggcgatgcatttgtatatggtgaatttcgagtttggggaatcagaattgcaagatgggagagttaaattctagtttgttgaatttaaaaatgaaataaagttccagtaatcatagagtgtatggattcaattccatatgctctttttctttacttaatttcatgaaaaatgtaaaaatctaatgttacgagttgcattaaagaaaactcgtaagaaaaaagtaaaaaaatttgcttttgaccactgtaaaacatgctctgagcgtttcgttatatgaagggataatttttctttcatatttcaaagaaaagaggataaagaaatgtcagaaaaaagatgttatacagttcaagagttacaggaaatcttaggagtcagcagacctactatttataaccttttaaagaaaaaggaattccggtggatccagttggatggcggaaagtatcgcatctctaagaagagtttcgatgactggctcgataacttggaacaataaaaaacagggtgttgatcaggcagattttgtctgcaatcgacatcctaaatttttatctggatttgagatatgatataagaaaaaaaactaacactaaaaaagacaggaagtgaagaataaatggcaacagcaattatgaaacaaaaagaagttccggaaatggacgatgttgaagagatcatttcaaagatatcagaagacagtccttacaaacggcgtccgacacaaaagagaacctggatgaccgtgccggaaatgggaaagctgctgggattaaaaaagacagatcgatactggctggtgcataaaaatgtttttgaatctaaagagattgctggaaagatacgaatcaatattgccagctttgaaaaatggtacgccaatcagattaaataccataaagttaccggagaagaaccagggaaagaattgaaatcctggtcctattccgttaaggaagttgcggatctgttgggtgttgatgagtatcttgtttatgatttactcaagaaaaatcaaatggaagctgttattgtcgattactggaaacgaataccaaaagaatcttttcagaactggtataaaagccagtcccggtatcgaacaaaggaagacagaaaaaaagacgctcttctggaagatgcaacaattacgatgcctgagatggcacagctgcttggaacaaccagaagcgcagtatatacaattcttgataatccaaagtatagtcatttttttgaattcattgtgattgcagaaaagaaaaggatcacaaaagagagttttcgaaaattcctggaaggtcaggatcggtataagctggatccatcgaatgattatgaagaacttgcacaggaacaaaatattgccctggctaatttccggcggaagaaattatcacagaccggaatacgaggaagcaatggaaatataaagtatcttacttttgatgaagcttcctatctggcaaaggtcagcagaagcatgatcaacaagtgggcggataaaggaaagttcacagtaataaaagttggcagtcgagttaggatccgtcgggatgaatttgaggactggatggagcaaagagatttggaaaggagtatgcaataatatggcatctataagagaacgaaacggaaaatttaatgtaatctattcttatacgaatgaaaaaggtgagaggaaacagaagtgggaaacctatgaaacgaaagccgaagcaaagagaagaaaaaaagaaattgaatataaaaaagagatgggatcatttgtcgtccgtaaatgcaaaacactggacgagcttattacagaatatgttgcactttatggcaaagaaaactgggcgctttctacatatgaaggaaatgtctctcttatcaataactatattcttccgatcattggtgatacgaaactctcagagatcaatacccgtttcatcgaaagatattatcagagtcttttgaagagacgtgcagttatcaatccattgaataaaaccagtcgaaatgaatttgtatcttccagtacggtcagggatattaataagctgcttagaaactgttttgaacaggcagtgaaatgggagttgatggagaagaatccttgcacccatgcgactgtaccaaaacataaatcacaaaaaagagacatctggacagcggatacattgatgtatgcgctcagtgtctgtgaagatgaacgattaaagctcgcaattaatctatctttctcatgttccctgcgacttggtgagctgcttggtcttacctgggattgtgtagatatttctcatgaggcaattgaagaaaaccgtgcatatgtcttcatcaacaaagaatcacagcgtataagaaaagaatctttaaatgcattggatggaaaagatgtgttgttggtatttccgacaaatcataagaagaattctacggtccgtattctgaaaacaccgaagacagaaagtagtgtacgtaagatattcttaccgaagagcgttgctaatatgcttgtagactggaaagctgagcaggatgaaatgaaagaaatcctgggtgacgaatatatggactataacctggttatggcaagtacctttggtcttcctcttggtgatggagcaatccgtggccctttaaagaaattgatcgaggactataatctcccaccggttgtatttcacagttttcgtcatagcagtgttacttataagctgaaactgaatggtggagacatcaaggcggtacagggtgattctggccatgctcaggtcaatatggttacagatgtgtactctcatattctggatgatgacagaaggaaaaatgcagagctttttgaagaagcattttatgagaaaaagaatctggatccacagatgcatgtacagcaggaaaataataatactactgttgctgatgaagtcgatccggaacttctggcaaaagtattggcgaatccagagatgcgggcattgctcaattcactggcgaagacgatgaagtaatgaaaaatagtgaaaaaatagtgtaattttagtgaaaaaacgattcataaaacgatataatatatggatgaaatgaggatatttattgtgtatatggatattctatctccatcatttgatgatagaatgacggagataaatctgaaatgaaggagattcctatgagagactttgattttattgtaagtcctgcgaagttgttaacacctgaaattgttcagatggttagcagcatccatgaacataaaggcaaacaggaattatttctcgaagccaatgtagatgaattgaaaacactcttagaagttgcattgattcagagtacgggagcatccaaccgaatcgaaggtatatctactggttatgtccgtgtttaaaaatatgaaagcagcttataaattcaccagtcaaaaacgcatggacaaaccgtctcgtatgcggtatattatttatagacaagaaaatatcttgtacttacgataggaagtttaattgaatactgtttaccatgatcgaacgtacgaagcatggtggtcatataacagatgtcgatggtaatatcaaggcattccccgattattagctggcgcaaacaatcagctaactttcagagctttacagagcttgacagagggggtattcagaataactcaaattgaatcggaaacagttttatatagtgtcccaattgggtttaccttacctcagattgacagagagtgacaataggttggagctctcctaagcgaggggtcggaggttcaaatcctcttggcgacgggcttcaaagcgttcgaaaatgttagctggattagctgacaacgaacgcttttgttattttctaatcacgttcgtgacacaaaattccattcaaaatgatcaatttccagctaacgcaatccgatttttgttagctgacagctaatctgattgagattcgatccgatctttccatattcactgaccagttttctgaggtcattcatgtctgcaaccacttcaatctgatgattgatttgtttttcaagcaggagttttctcagatattctgatcggctaatggacaaacaagctgcaccttgatctaataaatccagttcgacatctgtaagacgtaatcctataaaatgtctgtgatttagttctttatctttgttttctgttctcatattcctcctttcgctgcgactattcctcccaccgggagtccacgtattttaatatcggctgtcccttccgatattagaaatagtgctgtgaacacctttaggtggaaccaacagacaagtgaaacgtctgttattgagagggtattgggaaatccccatcaagataaatcccataggagaacaagatgccaaatggcaatactgttaaacatgggtggatcttgctcttatttgtacccctctatataacgaaacgctcagaggctgttttacagtgggggaaatgaaaaaaatcaaaaacttgatgattaatggtgagcttgtgatagaatggaaaaaagagaaaagcataaaggatgtagttgtggagaatatttgttatgattagaaaattgctgaacggagatatcgatagagttgcctacatatggttaaagacaaatctgaaagcacattattttatttccaagcaatactggaaaagtaattatgaactagtaaaagaaatgatgtcacaatccgaagtctatgtgtttgaagcagataaaatgatacaaggatttgtaggactaaacgatgaatatatcgaaggtatttttatttctgaagaaatgcagtcatgtggcataggtaagcttttattggattatattaaggataaaaaagtcagattacaattaaatgtataccagaagaataccagagcaatttctttttaccaaagagaaggtttcattattcaatgtgaaggtttggatgaagttactggtgaaaaagagtacaccatgctctggaaacaaaaatagaaatcggaatttgaaggtgcgattgatgaaaattatcgaagttaaagagaataaaaaacaatatcttgatttgctcctattagcagatgagcaggaagatatggttgaccgttatcttgatagcggcaagatgtatgtacttgatgataatggggtcaagtgcgagtgtgtcataacggatgaaaaaaatgatatactcgaaatcaagaacattgcgacagttccagaatatcaagggaaaggttatgcaagagccttaattgagtttattgttaataattacagagaacaatacgccattctgcaagtcggaacaggcgatagcccactgacaataccattttatgaaaagtgtggttttgtccgttcacatattatatcaaatttctttacagataattacgatcacccaatctacgagagcggagtacagttagtagatatggtgtatttgcaaagacctttataattaacttccagttgttgaactgaatccgaaaagcattagggcgcagaggagatagaatcctttgcgtaaaagactaacgaacatatttaatgaaacatcggaaccatcttctttttgttgtctacctataataacgattggagtagtcgattatagacactgcaatcaaaaaaatctgaaaatatatttatcaacattacataaaagtgtgtagatgcacggaaatggggagtataacgatggagattaaaagagacgcttacctacagcagctgatcgagcgaaaagataatggaatgataaaggtgattaccggcattcgtagatgtggcaaatcctttttgctgtttaccatctttaagagatacttactggagaaatgatataaataaggccacggctgattggtatgctccccgtcaagaggacaataaaaaataataaatttttgtatcgtcagccatgctatggctggcgatattttatgctgcttttgtatattgctcatgatatttcattggtgtcattacatgcagtttcctttgaagtcgttggttgttgtagtaatctatgtaattagctatcgcagtaatcaaagagcttctgtcattaaaacgctgtttataatacatttctcgttttagaattccccaaaacccttccattggtccattgtcaatacagtgggcaactctagacatactctgcttcatatgatgtttttttaatctagtataaaactgtgcgcttgtatattgaaagcctcgatcagaatgaactaatgggtgtgcatctggctcctgacgaacagcctcatcaaacgtgtccataactaatggattatcattatgatcgctgattttaaaggaaacaatccttctatcatataaatctaaaatagcactcagataaactttatgaacttctattccgttgtagtatttaaattcagaaacatctgtaagccacttttcattcggtttttcggcgtgaaattcacggtgtaaatagttttttgctatgtgatcaggatttctgtctcctctggtacaactcttaggtttccatttaatatttgattttatatcgtatttcctacaaatacgaagtactcgtttatcattcacatgaattcctttatgtccatctaattcatcacgaatcctccggtatcccatatctggatgctggtgatgaatcctttggatttcagtggatagtctttcgtttcgaagttcattattacttttcggatattttccccagcggtaatacgcagaacgtgtaacattaagatatttacaaagtctatctatgggataatgcttagtagacgatagtttttggatggcttcatattcggctaaccgatggattaaagatagcgacccctcctttccagttctctgactttttttaacagatcattctccatttgtaggtctagatttcttctttccagttcagctatcttgtcacgtagctcttcttcaggtgttctgcttggaagagaagctatacgacgtccacgtctgtcttccagacccgcttgacccatcttttcgtatcgtattacccaattgcgaacttgttgataggaacaatcatatttgagtgccattgcaccataattcttatcatttgcaagacaatctgttactatttttaatctctcatcaagtgtagtgttctttgcctttttcatgtaagcacctccagtggatgtttttaatattccaccagaattatacaccttaatccaatcggaaagctgtctgtgtgaacgaattccgtattttgtgcaaatatcctgaagagatccttctccgttaagataatcatttatagcagatatttttaaatcttttgaataagatttgtttttcggttgattgagtaatccagttggtccatcatactgataaatagaaacccaatttcgaatactatgatgatcaactcccaattcttttcctgcttgctgtatgccaatttctcctgcaaggtagcgttcgactatttttactttttctactggttctatcttactctttctgaacatgaaaatacccccatataggacttttatatttcattgtcctatatgagggtagcatatcagatttcatgttggaacagccgtggctcagtttatttttttatccgtacaaacgagactgttccgcagattatgtagaacagacagagtacgattccgatagtgagaacatacgagaataaagatgaacttaagaacgagataaacaaaagtttgttgaattaaaaatgaaataaagttccagtaatctttgctgatgtaggtgttatgattatcaccatattaaatgcaattcgctgtctgtttgtgaagaaactgtaaaaggcaggtagaacatggataaagaaaaagaaatgttatccgatgaaaaatttgtaccgactttcagaattttacaagatttttgccaatgaattgtgtatatagcagaaatcctgcaaaatcctcaagcagcaaagaaaactgcgaaacagagcgtatgaaaatagatcatacgctctgtttttttgcaatattttattatcttgcgaatttatcattgtaacgaatatgcatatctttccaatccatgaacaatacgtaaaatacctttccgtattgcgggttctctacaattcttccatgatcaagcacagaaaaataagttccgtcagcttttcgaagatggaagtgaatatagtcattttcattaccactgtcaatctgttcccagatacttgattctatctgttgctgttcatcttcccggatcaagttgcgaaaacttttcttagtaagtctgaacagttcatctatatttttatatcctgacatatgaagaaattcatcatttgcaaaaaatagttcatcatcttctttgtcagctctgtatatgatgaatgcacctggaagatgttccgcgatatccttgaatgcgaatccaagctgtttgcgggcacctgaccgaagtccttctctgtagaccatacatccattttttccatgaagctttatttcataaagagcggcatctgcgcagcgcatgagttgtgaacgattggatgcaaatgttggatattctgcatatcctagagaaatataaaatgcatgttccttaccatggtatgagaatgatttaggaagtttggtgaatttctgcagctgtatatctgtttctgcaaaggtacaatttggtaaaagaatgcagaattcgtcaccaccatttcttccaagtaatgcatcggatgggaaaaaagtcttcatgctgtctgcaagattctttagtgccctgtctccataattatgtccatagatatcattaataaacttgaaatcatcgatatcaaggagcgcagccacaaaatgtgcttttggatttttttgaatcattttttctgcaaattcatcaaatccatagcggttataaatatttgtaagagaatctgtgcgcgccagtatctgaaactttttcttatgttcttttgctactaaccatactctggtaagaactgacaggagaaggcttattgtaagaaatattccgatgatgattatcagtaatgtggcatttctccatccacttttaggagttacttcaaatttccagttttcatctcctattgtaaatgtataagaaacaggatgatttatttgcccatctgattgataaaccactttataagtatcactccatggagcgtctgtttttgaaattttgtattcgtatccaaaatttgaaagtgcactgattgaatctgaaaaaatatccggaacacgcaggataacaatagtaaatccccagaaatactcatgtccgtttttatctttcaggtatacgggattgcggactgcaattccatatcctccctgttttaatttgaaggggccctgcgtaatgattgtatggttgtctcttgcgtaacaggaaatttttccgcggtctttatcatggatcaaatcaatcttacctgcctccttttcattagccggataaatatctgtaacaacaccattaggagcgagctgtacactttcaatagaatcagacataagatttcctgcaattgtttcaaactgatggatttcgccatcttcacttattaagatttgcttcaaagtatctgtgatctcaattccatttgtaatttcattctttattcgttcgccataggtggctacgtttaattgtgctgttatgtgtctctgctctttttcgtgggcgtctgttttgtatacaatcaaactaacaaggcatatgcccagtaaaaaaatgataagaggcacaagtgttttctttttcacttggttcacctcattttgtccatgggaattattataataaagcattatatcacagaagttgaaaaacagaataagttttatgaaaaacggactgtgcataatccttatacatgaaatgaaagaaatccttggtgatgaagtcgatccaaaagacaaaagaaacatattatgaacccttcaaaccaaaccctcaagtttgcccctcaaaccattattaatgaaacggatcaaaagctctgttctttcatgagtgaaagtctgtatacacgtctgccggtttcttcataatgctgatccagaagatcacaggttgtctggagatcgttaatccggatggcctccaacagacattggtgtgtccatactgcagcgcttccgttataagaggtattttgatccggtgtgtttggttctaagcatttggcattctgaagcgtttcagcatctccgcttaactgtccaaagcgattagcattttgaaccgagaggaacatggcaccattcagcggactcagcagctcccacattttggtcagtcggttaagctgggcagaacgaatgatctgcaggtggaatgtctcatctgcacgaacagccttcatagtattgccttcgagaatagcctttcgaaattcttcaatactggcttccattatcatgagactatagtcactaagaaggcagttacttttttggattgccagtttttcaaggctgccgcgcagaaaaaagacttcataagcgtcttgtggagaaagcagtgcgactgtacatcctttgttaggacagtaatcgactaaaccttcgacagcgagctgtcggagtgcttcgcgcacaggacctcggctgagtccgaatttccgggcaatttcagcctctaccagtttttcttgaggctgaaggattccattgatgatctgctcccgcagagattcaagaacaatttctgatgtagtagtatttgatgtttttcgttgtttctgcatatttacctcataaaattttcagaataagtatccgttttcgataggtacgcttggttcatagtagaacataccgccaatttctcgcatgtttcatttccttactaattaatagaaaaaattatacggatgtcttttgtccgttagcaaaaaacttattataattatagtggattgttagcaaaaacgaaagcactattttcccgctgttaacattaagttgaaattgttgacaatcatatttgcatggactatacttgggttatcaagagtagctcaaaaattctgcattgtcataaaaaatcctaaaggggaataggaagcaacgcagtaattgatggatgtcggactgtctggtttccgaatagtccgattttcagctaagaagaataattatagtaggaaggagagaacttatgagacttacaaatttgacttggccgaaagctcaagaatattttgaaaaaaacgatatggtacttatttctatcggcagtattgagtgtcacggccgtcatatgccgcttggaaccgacacactgattccggagcatttgttggagaaaatcgagaaaaagagtgatgttttgattgctccgaccattccatatggttcctgccagtgtttagctccatatccgggtacaattgatattgacaatgaggtactctatcaattttgccgtcagatttttctgagtctgtatcgtcacggcgcaagaaaattcgttttcctgaacggacatggcggaaacatcaagatgattgaacgccttggcatggaattcgaagataagggctgtctggtggctatgcttaactggtggctgatggcatgggatatgaacccggcgtggaaaggcggccacggcggtggtgaggaaacagctgcgattcttggaattgatccgtctttagttgataagagtgagataggtggtgaacttcagtttaagcacctgtctgataatctgaagacaaccggtttccattctgttgagttcaagggagttaacgttgatattattcgcaatactccgcatgtaacagacaacggctggatcggaccggatcatccgagtaccgctacagaagagtggggaaaggaaatgcttgagactacagcaaactatattgttgatttcatggaagaattcaagaaaataaaactttcataaagaggtgtcataatggataaaaaaacaacgctggaaatgattgcagcaatttcaaatgcaaacggtacatccggtttcgaagatgaagtggttgcagcgattcgtccttacgcagaaggactcggagaaattacagaagatcgcatgcgcaacctgtatatccgccgtaaagaaaataacggcaaacgtccggttgttcagcttgacgcacatagtgatgaggttggttttatggtgcaggctatctgcccgaacggaactctccgcatcattcagatcggaggttgggttaaccacaatattccggctcataaagtcttggttcgcaaccggttcggagaatatattccggggcttactgccagcaagcctccgcatttcatgacagagcaggagcgtaaagcacctctggatatgaaagatatcacggtagatgttggcgctgtttctaaagaagaggcggttgaaaagttcggcattcgtatcggtgaacccgtagtgccggatgtaacatttacatattcagaaaccacagatctgatggttggcaagagctttgactgccgtctgggatgtgcggcaattcttaagactatgcataccctggctggtcaggagctgaatgtggatattgttggcgcttgtacagcccaggaagaagttggtgtacgcggtgccactgtgacagcacaggtaattaaaccggatatcgcaattgtttttgagggatgcccggcagatgatacctgcgttgagtcgtatatggttcagacagctatcaagcgaggaccgatgctgcgtcacattgatgcccgtatgatcaccaatccacattatcaaagatatgcactggatctggcagaaaagcttggtattccggttcaggatgcagttcgtagtgccggttcaaccaacggtgcagctatacatctgactgaaaaagcggttccggttatcgttatcggagttccggttcgctatgcacatacacattacggaatttcagcttatagcgactttgataacgctgttaagctggcatgcgaaattcttaaaagacttgacgaagagcaggttatgagtttttaaatacaatacataaaagaaataaagcattttcgagacatactaacagagaattgtattgctacgcttgaatgttacctaaatcataaacaaagcattcggaaaacctcagagctagcagaaggttaaacatggaatcctgataaataggaatacaccaaaaaaataggggctgccgcactaatgcgacagcctcatttagcatatatcttcagtaaatgaattattcctgatcaagtatggactgaatttgtttcatcagttgctcgtagtttgattgatcatcaattccgcccatgaaaggttcgccaacgatatttccgtctttatctacgagaactgttgtcgggaatgccataatgtttcctgcatattttccaactgttgaatcggagtcgaaagtcaggtttttgtaggaagctcccttggccttcaagatttctttcgcttctttgataccatcctgattatcatctaatgtatctgtattgataccaacaacttcaccgcccattttcttaattgtatcatttaattcattcagtttagaaagttcttcaacgcaaggcttgcatccactgaaccagaagtttacaaccgtaactttatttttggtgaaaaggctttcatctacatcgttaccatccaggtctttccctttgaaaccgtgaaacacacctgtagagtcatctgtgccggaggaactactgccggaagaaccagctgcggcaatttctttttcaagttttgcaatttcttcttcaataccgcggatcgtttcaatgtctttactcagagtagcatattcttcttcggagaaagaatctttgtttgattctattatatttgcaagaaagtccgcatagttttcattcttggtatcatcgtcaatgttcttgctcataaagccaaatgctttgtcccacacatctttgtgatctgcaaagatctggttttcctgttggtaaaggtcattcagcttttcattcagatcacccgaactgcttgaatctgttgtggaagtatcttcctgctttgagctttcagttgttgcggaaccggatgaagttttgcaacctgtgaatgcaaaaagaatgaaaacggcaagagatgccgcaattactttttttaatttcattgagtttgttctacttgttttgtttttcatgatttttaatctccttttgaatatcatttgattcatttttgcttatttattgtcagcctgtttcttgcctgaaaatccgtaatgatagcagatcgcatttgtcggacaggctttcatacatgtaggctaagtacccagcgccttgccatattgctatggtaggtttccaaatactcgcccccgaaccgtacttacaactctcactgtatacggctctccatttataaactcaatttaactgtccacagtgtaatttcttatgacattctctacacaaagctattgttttgcgatttctcgctatcataagagcttcccaaaaagttttaccttgtaaatctttaagccgatgaacatgatgaatttctatgggagtattagtttttccgcatagctcacattctctggcttttattctgtcgattagctttgtactgctgaaatatttgattgtatttggaactaagtctgcattagattggaatgcttttttctgccgtttaaaaccctcgttataaaacactcgcattttctcaactcctttggaattacggaactttacagcaaaatcttttcctgctctgaattttccgattacttttgaaattgatgttctgtattttgtgccgtaggttttgtacatactgtattccataatatacttgtagctgttgatgattgagctgttattggctatacagtaataattgtaaaaacctcgtatcatactgttgtagtagtcgagtatttccagatcatcacagtttttcaatctgtatattgccttgggtttccaaatttcttttccattatggtagattaacttcatagcacctgtatcaatcaagtgtttcctgattgtatcacttgaaacttccagtacaattctgcccgtgtaattacgaacgagcttgcctgttttatctctcttggttagattgctatgccgtactctgatttcataactgagaaatttcgcacttttttgggcattggtaatcagcgttttctcttctgatagctccaactgtaattgttctttgagaaaattcttaaaatcttcttttattttcttacaatcctctttcgaaccgataactccgcacagccaatcatcagcatatctgacatagaccagccttgcataattgttatccatagggtcacttgggggaatattcacccgttctttttccaactgccttatgcgtgcaatcgcattttctctttcacagtcgtcgtttgcatttttcaatgcgattctggctttgcttaattcgacttcgttcctgcggtactcttttgtacgcatacgctttttaccttttttaaattttcggacatactcatttacatacttatcaaatttatccaaataaatgtttgcaagaataggactgataatgccaccctgcggtgttcccgaataggtgttatgaaaagtccaattctcaatatagcctgcattcagaaattttcttaccagtcgaagaaatctctcgtcattgatacgttctcgtaaaattccaatcaacgtagcatggttgatgttatcaaaaaaacctttaatgtctccttcgataaaccatttcacacccgtgaaagttttttgaatttcattgagtgccgtatgacagcttctattaggtctgaacccatgagaagtattttcaaaatgcccctcatagatagcttctaaaatcattctgataacctcttgaagcaatttatcctcaaaggacggtattccgagtggacgcatttttccgttcttctttggaatataggttcttcttgcaggttttggctgatagctttcatctttgagcgaaactatgattttccgtattctttcgatactcataccgtcaaccgtttgcttgtcagtaccttttgtcatacttccgtcattggaataaatgttttgataagcggttaagtacagttcctcattgtagagcaaacggtataaacgctcgtacttgtaatctttttggttactgtgtttcgttaagctgattaacacattttcaggatttctcataatgtatcacacattatcctttctatattgttaatgttataaactgccttccttcgccatgtaagtgccattaacactctcggactactatgaaggctccgttaccatatcgaatattcataagcctacacttaatagcttatttttaagcgtttcgacttaggtaatccccgtttagcatcatactaacgatttggcttgttaggttgtcggatacgacttccatccttttatgcttattgcatatacgtctcagcctatctttgcttacgctcctgaacagcggaacataagtgctgagatatggcgaataataattaccttacgccatagtcccgacattgaccgtttggactatcgttcaaccagtatgggctttatcctcatacctaacttttcatctccccattcagtcgcagcttggtaattagctgacttatggctttaccgacgtgctattttccctgatatttagtttccctcacaggtaaatcggttgatgataggactgtaagatactatcctaataccttgccaaaggtatatttattatgatgcctttacgggcgcacgctccacatcggatacattccgggtgatccggtgtgtctactacatttacatccattttacaggcatggctgcatttttgacagttaacacatttttcaggatccaccttaatcttaagtaatgatattttgttaaacagcgagtagatggcaccaagcgggcagatccacttacagaatgggcggtaaaacaaaatacttaagatgattacaagtacaaggattgtaaacttaaacgtaaataaattcccgagtgccgcgcggattcccgaattaacaagtgccagtggaattgcaccttcaagtacgccttgtggacatatgtatttgcagaagaatggatcgcccatccccagcgaattagtcacaaatgccggaagcagtataacaaaaacggccagaaccgcgtatttcagataccgcaggggttttagttttgcagtagacagtttcttacccggaattttatgcaacaaatcctgaaaccatccaaacggacagagaaaaccgcagataaatcgtcctaacagaactcccagcaagataaagaatccggtgatgtagtaggtgaacttaaattttgatgaaccgactacagcctggaaagctccaatcggacaggcacctgtggcagccgggcaagagtagcagttcagtccgggtacacatattgtttttacctttccctgataaattttccctttaaacagattcggaatatgaagattggtcagcagtgttgcagctgcctgaaaccatccgcggaaacgaaccaggaagttcttgtttgattttaatttcttatccaattccgacacactccatacataattttattgccttactgagtacagttgcagcttctccacggtaaatcccggcaaggaaaaatacaagaccggctgcaagtaaaaaaatttgtgttgctttttctgatttcattaagataccacttgttactgtaaatagtaactgctcctttcaatgttattgctcaaagtcggcttattgaccgttcagtgactacattatataatatgggatgtaaatttcctgttaagaaaatggagaaaagtaaattgagattattagttgttgaagatgaaaagaaattatgtgatatgatcacgaaaagtctgcatctggcaggttatgaggtggacatatgtaatgacggagagcaggcactggagatgatctatgcggaactgtatgacctgatcgtgcttgatcttaacctgcccggggtggatgggatggagatccttcgggaacttcgcaaagaaaatgaagagacaaaagtattgatcctgtctgcgagaagtcagatcgcagataaggttgaaggattggattccggtgcaaatgattatatggaaaaaccatttcacctgcaggagctggaagcgcgcgtgagaagcctgacaagaagaaaatttatacaaaaaaatatctgtctggaatgcggaaaacttcgatttgatacgagagaaagggttgcatatgcagacgataacccggttgcgttgacaagaaaagaaaatgggattttggaatatctccttttaaatcagggaagaccggtcagtcaggaagaactgatcgagcatgtctgggattcttctgtggatagttttagcggttccatccgagtacatatgtcttctttgagaaaaaaactgaaagcaggactcggatatgatccaatcgtgaacaaaatcggtgagggctataagataggaggaaatagcaaagcatgaagaaaatatcactccagtggaaattaacacttcttacaaccgtgttgatcaccatattatgcggatgtcttacctttttcttatataaaaacggagtctattatttcgatacgcttcaggagtctatcacggatcagggcacagagccggaatcggtgtacattgatattccggataatgagtgggatgactttgtggcacagttttccatgaaggtttataactccaaatcagattatagaagcagaagccttctgattactgctattgtagcgctgtttggcggcgcagcgacttattttatcagtggacgggcattgaaaccactcaggaaattttcagagacagtggaaaaagttcaggcacagaatctgaaagattatacgatcgaagagaataagattgcagagctggacagacttcgcatatcttacaataagatgcttatacggctttcagaatcattcgagacgcagcgccggtttacgggaaatgcagcacatgagttacgtactccactggctttaatccaggcacaactggatctataccatacaacagaacatccggagagtaccgcagtggcagaagagacaattcagatggtaacggagcagaatgaacgtcttagcaagttggtccgaacgcttttggatatgagcgaattacagaccgtatcgcgaaatgacagaattgagctccatagtctgatcgaggaagtgctgacagatctggaaccgctggcacaggaaaaaaaggttgaactgatacagaagtcacagggagcaggagcaaaggctgatgaagaattgtttttgacagggagtgatattctgatttacagaatgctatataatcttgtggaaaatgcgattaaatataatcgggaaaatggatccgttacggtatcggcaataaggaagaagaacgaagttgttctgacggtttcggatacaggaaatggaattgatgaagcattcagggagcagatcttcgaaccgttcttccgggtagataagtcaagaagccgggaactcggaggtgtggggcttggccttgcgatggtgcgggaagttgtgcgggttcatgacggaacgattgaagtttatacaaataagcatagcggaacgacatttgaagtgaaaatgggtatagggacagactttgaaaaagcagtataatcgaaaaacaattcgcaaatcgatcatactgatgtttatcgcttccacctgccagaacatggagaatccgtcttacaattcacttaccgtatcaaaaataaactgaggattattatttttgatacggtttaaattatttcagacagacatccataaaatcctgcactaccgccgtcggcttccgccccttctgccagatcagaaggatcttcgtcaccagatccggttcatcaagcacctgacaagtcagcccttcgcaaagcggctccatggactgcgggaagatcgccgtggcaagcccttccttcacccaaagggtagcgcccctggcatcatcacacaggcagaacacctccggaaccagattctgcacgtgaaatgcatccataatcagcttttcatagcgccggtagagaattaacggtctgtggactaaatcttcaagaatgagcgatttccgtccttctgaaggcatctccggattggagacagcgatcatcggctccgaatgcaggactgcggactccacatcatccagccggagcggcgtgcggacaaccgaaatatcgatgatcccttcctgaagataatcatataacgtatacgtgatcccgtcgtgaacctcaaaattcacgtcgggatttttctttgaaaattctgcgataaacggcatgactgtgccgaccgtcgtcggcgtgatcccgattctcagaaccctttttttacccgtttgggacacctcaagctctgtcgatctggcataatccagaaggctcgccgcacggtcatacaaaagcttacctgccgccgtcaggatcacccctttatgggtacgctcaaacagctgcacgttcagttcattttccaactgcctgatctgatagctgaggggcggctgtgacatattgagctttctcgccgcttcattgatgcttcccgtattcgcgatttcccggaaatattccagctgtctgagttccattttcttttttccctccgtttagttatatgatgataccagggtcaaaaggtcagaaagccgatgcaagcttgcttgcaagaggatttttgacctcttgacccgccaaaaacatgagtaagtagccatttttcaaagaaaaatgagcggattacgaatgtttttgaggattgcgagagtgcaaagcacgtagcaatctggtatcaaataggtcaaaataccttttgccactcacattgttatactttttttatattaagctgtcataaaaacaatattattcatattgatggtagcgcattataatgagtaggtcaagaaaaaactaagaagtaaagaacaggagtgagtgtgtttgaagaaactttgggtttatctgaaagaatacaagatagaaagtattcttgcaccattattcaaactgctggaagtcgtatttgaccttttggttccggtggttgtcgccaagatcattgatattggtattgcaaacaatgaccacggctacatcgtaaagatgttcctggtgctgatcctcatggctgcagtcggtcttagctgcagttttaccgcacagtattttgctgcaagagcgagtgtcggctgtgcaaccaatttaagacaggccgtatttgaccacattcagggcttttcatttaccgaacttgatacgatcggtacggacaccctgatcacacggatgaccgatgatatcaaccaggtccagaacggcatcaacatgggacttcgtcttcttctgagaagtccgtttatcgtaatcggttcgatgatcatggcatttacgatcaactttaaatgtgcgctggtattcgttgtggcgatccctcttttatttgtcggcgtcattttcattatgctggtcagcatcccgcttttcaaaaaagtgcaggctgccctggaccgcgtcacaggacttacccgtgagaatctgacaggtgtccgcgtgatccgcgcattttgccgcgaagaagagtccgtaaatgaatttggaaagagcaacaccgaactgaccaggttaaatgaatttgtcggaagaatttccgccctgttaaatccatttacctacgtgttgatcaacattgcaactgtcatcctgatcgcaagagcaggactccaggtcaatctcggaaccatgcatcagggacaggttgtcgcgctttacaactacatggcacagatgatcgtcgagctgatcaagctggcttccctgatcattacactgaacaaggcgatggcatgtgcagaccgtgtagccggtgtcctggatatcaggactaccatgcattatccggaaaccccttctgcaaaggcagatccttctgcaaatgaagttgaattcgacaaggtatccttcacctatgcaggtgccggtgcatcaagcctttctgatatcagtttctctgtaaaaaaagggcagacagtcggtatcatcggtggtaccggatgcggaaaatccactctggtcagcctgatctcccgtttctatgatgtaacctgcggaaccgttaaactgaatggacgcaatgtaaaagagctcaccaatcaggaaatccacgacaaggtcggaatcgtacagcagcgctccgtccttttcaaaggcagcatccgcgataacatgaaatggggcaatgaaaatgcatctgactccgagatctgggatgcactgaaagttgcacaggcaaaagaagtcgtagaaggaaaagacggccagcttgatttcatgctcgagcagaacggaaagaacctttccggtggacagcgtcaacgtcttaccattgcccgcgctcttgtgaaaaagccggaaatcctgatcctcgacgacagcttaagcgcacttgattttgcaactgacgcagcactccggaaagccctcgcaggactggaaggagagacaacaaccttcctggtatcccagagggttgcaggcatccgccaggcagacaagattttagtattagataatggagaactcgccggatccggtacacatgatgaacttatgaaatcctgcgaagtttatcgtgagatctatttctcacagttcccggaagaccgtgcaaaatatgaaacaggggagatgtaggtatgaaaaaagacagtgtaatgaaaaagctttttaaatatatcggaaaatactggattctcctgatcctcagcatcatccttgccggaatatcagtggttcttcagctttatgtgccggttctcttcggtaatgcgattgatgagatcgtagcagcgcacaatgtagactttacccagatgtggctctatctgaagcagattcttctgttcgtagtgatcgctgcaaccgcaatctggatcatgaaccttgtcaataaccgcatgacctatcatattgtacaggatatccgatcccaggcaatccgccacatccagaagcttccgctttcttatctggaccagcacagcaccggcgatattgtgagccgtatcattgccgatactgatatcctttctgacggattactgctcggatttacccagttattttccggcgttgtgaccgttgttgtaaccttgatcttcatgttttccaagaacgtgtggatcactttgatggtcatccttctgacaccactcagcttcctggtggcaaaatttatttcctcacgctcttttaccatgtttaaaaagcagagtgaaacccgtggaaaacagactgctctgatcgaggaaatgatcggaaatcagaaggttgtcaaggcattcggatatgaggacaaggcttcaaagcgttttgatgagatcaataaagaactcaaagaatacagccagaaagccgtattttacagcagccttaccaatccgtccacccgtttcgtaaacaacattatttacgctgccgtagcacttgcaggtgcattcctgatcccgcttggagccctgactgtcggcggtctttccgtactgctttcttacgcgaaccagtacatgaagccattcaacgacattacatccgtaatcacggaaatgcagaacgcccttgcatgtgcgacacgtatctttgacctcttagaagaaccggaagaagtaaacgattcttctgaagtacttgagaaggtggatggaaatgtggatatcgaccacgtagatttcagctatgacaagagtaaatctctgattgaagactttaaccttcaggttgaacctggtatgcgtattgcgatcgtaggtcctaccggatgcggaaaaacaacatttatcaacctcctgatgcgcttctatgacgtggattccggaaaaatctgtatcgacggtaaaccgatcgatgagatttcccgacattcgctcagaaagagcttcggtatggtgcttcaggatacctggatcaaatccggtactgtccgtgaaaatatcagcttcggaagaccggatgccacagatgaagaaatcatccgggcagcaaaagaggcaaaaagctgggatttcatccgcagacttccgcagggacttgataccgtcctgcatgaggacagcatcagccagggacagaaacagctcctgtgtatcacaagagttatgctctgtctgccgccaatgctgatcctggacgaagcgacttcaagtatcgatacccgtaccgaactgcaggtacaggaagcatttgataacctgatgaaaggtcgtacaagctttgtcgttgcacaccgcctgtctacaatccgcaacgcttccctgatcctcgtcatgaaagacggtaagatcattgagcagggaacccatgaagaactgctgaaagaaggcggcttctacagtcatctgtataacagccagttccaggcagtgtcataaaaggataacggtgcaggagcggattcgtcagaaacacagataacagataaggatggatttatggaagcaccagatggtgagattccatttgattaattcagaataaatggttggagaggctgccctttgccggggcatcctcttttccattttacagaagaaatcaaaaattacaggtattcgacctaacgaaatcgtgatataatgagtgtaagagagctaacatgcttgcatgattggcgaacggcgaattggatcatgatagttgcgaagcaacggtcatgatataatcaaaatatatttgaatgagaaatatggagatagcttatgggcgtaagttataacagattgtggaaaatgctcatagataaaaatatgaagcgaatagagatgcagtacctcactggaatcagtggaaatattcttgcccggatggggaaaaatcagtatgtatcaatggagacgattgagaagatctgcaagaagctagactgcactgttgatgagatgatggaatttacagatgatgagtaacaggaggttaacttcccgtttatcgggaagtcgcagagaacgaaaaaacggtatttggaggtattcactatgaaaaagattataaccataatgctttgccttgtgctggttcttctctttgccggatgcggaaaggacggcgatatatcaaaagtggaaattgattatggaacatcttccgtttattcaaaagaagaaatagactctgccattgagattataaaaaagcagttcgcttcgtttgagggctgtgaattgcatagcctttcttatatgccggatgaagaatgcaacaatgcagataacattgaatggatgaacaatttaagaacggatgataataaagaagcctttacgcaatgtattgcatttgaaagcagtttccgttcgccggaaaaaggtggcggtgcatgggaagctaacgaagaatacacttggtcatggtgacttgcacggagtgaaggcggagaatggaatctgatgacttggggttattgataagagtagaaaattccagttttattgaccaagaaattaaggaggattcattatgagtgagaaaacagagattactttcatgcaaacaagattaatccggcttgcttcagaagagtggcatttacctgttgaacagattctccacttgtttaaagaagccgatgttcttggatatatagaaaaatgctatgggatttttcattgtgaaggtgatgaagctgtgcttgaagatattactgaatttttgcaaagaaatggcaaggtatgatatcattgcaggaaagattgcggatgatgcgacaaatgcaactcttacagcctaccttgcaggggcgtttggaacagcaggtgatcaggaagcagatgatttttgtattaaacagttgctgccaaataaattaaaagatcaatattgctttaaaacggaagcagctattgagtgtctaaaatttgtgaaaggtgagaagatatggctgaagtaacaattccaaaagaaaaactggattatacaatcgaccttcttatcgctatggtgacagaagaaatcgcagaagaaacaggcaaggacagaaaagaggtattgacagattttctatgttcaaagacaggaaaagcactgtatgatgagaaaacaaaactgtggtgcaatggtccggcatatataaccgaattgtatagggaagaattaaagaaatcctgatatggaatgtgagtttaaatttatacaacaatggcgagcaaaacttttattccatatagcgcaacaattaaatatttcaaaaacgctgaggtcagcatttcctaatcatggaacaatgacctcagtttttttataccagaaatcggcattcatgaatcagccggttctttttatttctccagatacgtgtttttgtattcttcacgaattgcttccggcacgagacttccgcctgttgcccatgcaatgtgtgtcgcatttttcattttttcttcaagatgattttcctgcagatatttgcgtgcagattcattcctttcaatctgtattggtccttcaaaagaagcacaagcacttggctcaagaaaaatgttctctgttccaagaaggtctctcatgtaatcatataattttccatcgcggatagtaaattcgccgccaagcagattcttcattactctgcctacaaatccagaaggacgtcccacggcaagcccatctgcatgggtaagtccggtaagcccaatatcctgtacggaaatctcctggttcagtccggttgccattccgactagcatacacggtgcctgtgtcggttctatgaaaaagcagtgtacataatctccgaacagcagcttaagtccaaagcatacaccacccggtgctccgcctactccgcagggaatatatacaaagagcggatgttcctcgtctactgcaacattcttttcttccaactgcttttgcagacgttttgccgctactgcataaccaagaaagagtgtttttgaattttcatcatccacaaagtagctgttcggatctgcatcagataaagcacgtccgtttttcaccgcttcactgtaatctgactcatattcctttactgttaccccgtggcttctgagtaagtcttttttccactgtttcgcatctgctgacatgtgtacgatcacctgatagccaactgctgcactcatgattccgatactcagtccaaggtttccggtggaacccacctgaatggtatactttttgaaaaactctctgcattcttcactcgccagtttctcataattgtcttccagactcaaaatcccatgctccaatgcaagttcttctgtgtgcttcaaaatctcataaataccgccgcgtgccttgatcgaaccggcgattgccagatggctgtcctgctttaataataagtttccttccagattgctgtcgtatttctcattcagcaaatccttcatcttcggaaccggtgtcagaacagattcaatgattccgtttctctcctttgtttccgggaaacatttcataatgaacggtgcaaaacgctccagtctgcgctccgcatcttctacatcttccatatcaagttcgatctgttccattgcttccccacaagctgatttgtccggatttttccagaacacctctttttcactacagatctccttcaagatcggagtcttttcctccagcattttcaaatcaaccattgctttcatacccctctttccatgacttgattcatatctatatattaccttatttcttgtattatgcctaccacaaaaaaactgtcaatcttaaaaaatagtgttataattaaaatatgtttaaaagaaacggggtaataaacatgggaaaagaaagatattctattttattcagcagcatgacaggcaatacaaaggaacttgccgatgcgatccgcgaaatacttccggaagaaactctcgattattttggcctatgtaaagatgcagatccgcagtcagaaatactctatatcggcttctggacagacaaaggaactgctgacgaagcgacaaccacactgttaaaatcacttagaaataaaaaaatcttcttattcggaacagccggctttggtggaagcgaagagtattatcagaaagtacttcacaacgtacgtgaaaatattgatccgagcaatcagatagtaggagagtatatgtgccagggcaagatgccgatggctatgagagaacggtatgtgaaaatgaaagaagatccaaaccacaaaccaaatcttgatatgttgattgaaaactttgacagagctttatctcatccggataaagctgatttagagaaacttcaaaaatctgttttaagataaaagaaaaacgataccgcagaaactcttatgaaagaatttctgtagtatcgtctttttttattcttctaccttccactctctggtatcaaagatgtgaagatgcagtgcttctgaaatatatcccaacaattcgcagcctgcgatacagtttccttttttgtcaagagatggtccgtagatcccgattcccattttctttttcgacacgctgaggagacctccgccgactccactcttagtcggaattcctgttcttaatgcaaattcccccgatccgtcatacattccgcaagtaagcataatggtctgcaccatccgcacagtttgagatgagatcagacgttttccggtggaaagctgcactccgtcatttgccagcagaagaccgaaccttgccagatctcttgcatttaccgacatggaacacatctttgtataaaaggtaacactttcttctacatcggtatcaatgatgtccttactttttaaaagataggcaatcgccttatttcttgcgcaggtcgccatctcagactgaaatacggcttcgtctatcgcgatctcctgatcttcgcatacttcctgcatatacttctgcatatcttcgatggaataatggttcactagcagacttgcaaccgtaattgctccggaattgatcatcggattaaagggccggttgctccggttatccaattctaccagtgagttaaaagcctctcccgacggctccacgcccacatgatcaaacacaaactctgctccaaacgtttccagcgccagacacagtgccattactttggaaatggactgtatcgtaaatctgtcctctgtatttccggtctcaaattgattgccgtctattgtgtaaaggcagatccccagtttattcttatctgccttggcaagctccggaatatacgatgcgacacttccataccggatcacaccttttccgatacggatggcattttccagtattctcgtaacttcttctgatttcatcatattctcctttttcgctcagtcgtaatcccctacaactgctatttcctaagtactaacatacatcattttccggcttcaatcaaccaccattttttgctgaaacccggcggaataagatagacaaaaaagtgcccgcattgtatattattagtagtttgaaactggggaatatgcaaaggggaaaacgtatcatgaatctaatttcgcaatacaaaggtcttagaaaagaaaactatgtcttatgctttggacgctttgtgacggccatgggggcaatggtccgtccgatgctgacgatgatcttaagccaaaagcttgggatgaatgccgtgcaggttgcctggatcacggcactgatggggatcctgacgatcccggcaaatctgatcggtggaaagatggccgatcgttttaataagaaaatgaatatcgtttacctggatatgatttccgtcatttcttatatcatctgcggactgatcccgctgacgacaaaatccattgtgctgatgtttatcgcatcgacctgccagaacatggaaaatccgtcctacaattcgcttactgcggacatcaccctcagcaaggacagggagagagggtattccctccagtatctgacagcaaatctcggcggcgtgatggcttctgctgtagccggatttatgtttcgcaattacttatggcttgcatttttgctcagtggaatttccatcggcacttcttctgtgctgatctatttctttgtacagaatatcacaccggaaaaagaagaaaatgatagcaacgccatttatcaggccgaacgccacggggaaagcctgctgacgattcttaaagaaaaccggcttgttctgctgttcattctgatcaccagcgggtacacagcactttaccagatgtataattatctctttcctatggatctgatccgtctgcacggggataccggtgcggtgatattcggaacagttaccagcatcaactgctttatcgttgttctcttcacaccatttatcacccagatcctgaagcgatcctccgaaccgaaaaaggcaatctacggatttttactgacactggtcggctacgtattgttcatcctcttttccggacacatcccgttctattatgcggcaatggtcgtactgacatggggtgagatttcttacatgctggcggaaagcccgtacatgaccaggcgtatcccatccagccaccgcggaagaatccacgggctgatggagagcatccgtatcggatttatgagtctgtaccagcttttgatcggatttatttacaaaaatcatacgccgacctttacctggatcatcgttcttctgacaggagtcgcattcatgcttctggctgttatcttaacgaaagaggacaaaaaacgctataaaaatctgtatcgtagattataataatgatgtgaacggcaaaatttacttttgacactcacatcattttaaaaagttataaccaaaataatacaggcaagaccaagattggattttctcctttctccggtcttgtctgttattttgctttccactataataagagtatcaaatacaaaggagtttcatttaccagattatgaccatcaaagaaatcgcacagctcgccggtgtctccagcgcagctgtatccagatatctaaacggcggctacgtcagtgaagaaaaaaaagaacagatccgtaaagtcatcgaagaaaccggataccagccatccgcacaggcgcgtatgcttcgtaccaaaaaggcaagcctggtgggcgtggtcgtcccgaagatcaattctgaatccatcagccggatcactgccggaattgaaagtgttctcgccgaaagaggctatcagatgcttcttgccggaaccgacaacacccctgcaaaggaagtagaatacctccggttatttgaaaattatccggtggacggaattattcttgtcggtacgatgttcaccgccggtcaccggaaatttttaaaagagacaaaggttcctgttgtcgtgatcgggcagcgcacctcacacgcaaactgcatttaccacgacgattacggtgcaggaaaggcaatgggacaggccgttgccggattcagtaaaaaaggagttgcttacatcggcgttacccgcgatgacaaggcggcaggtgccgcaagagaggacggatttatcgcaggactcaaaaatgcaggtgtcacgcttttcgaggaaaataagcgcacctcagccttcacgctggaatccggatatgagtctgctctggatcttttggaaagcaaatgtgatatcgatgtcatatcatgtgcaaccgataccatagcagcgggagcaatcgaagccattcagacctacttaaaaaagcagattccgacaaatgcagccgatgcaggtgcaagaatgcgctatatccttgaaaatacgtccatccgagtaaccggattcggagataaccagatgttaaaagccgtcaccggaggaatcccaaccatccatttcggctacaaaaccagtggaatccgcggcgcagagctacttcttgacagtattgaaagaggagaacagatcccgatcgagatgaagctcggcttccgtcttgttggagcagacccttcagactccgaaaatcttacctgattttcctgatttcccggagtttcttaaggaaacgaaagtttctttcaacacttttcacaaaaaacaatatgaattatcagtaaaaatgccatctttacaaatggcatttttttcatattatttaagcataaggtatgaaatcgattacacattgtatataaaggaggagagaatatggattacagaaaaaccgcaaaggaaattctgaatcatgtgggtggaagtaagaacatcgtatctgctgcccattgtgctaccagacttcgccttgtcattgcagacaactcgaaagcggataagacagcacttgagaatgtagacgaggtaaagggggtatttgaagcatccggacagctccagatcattctcggaacaggaaccgtcaacaaagtatttggtgaatttattgcaatcgcaggcatcacagccagcacgaaagcagaagcaaaagaagctgctgccgaaaagcagaactggtttatgaaagccatcaagcttctgggagacattttcgtaccgatcatcccggcaatcgtagccagcggtttccttatgggaatcatgaacgcactggatttcatgaacagtaacgggttcttacacatcagcacaaccagctcgatctatgtatttgcaacccttttcagtaacattgcttacacattcctgcagatcctgattgcattctccgctgcaaaagcatttggcgcaaatccttaccttggcgcagttatcggtatgatcatgatccatccgtccctgcagaacgcctacacagttgcaacggaaggtgttcagcagacacagagcgtgttcttcggactgtatcacattgacatggtcggctatcagggacacgttattccggttgtcatcgctgtatggatcttatccgtacttgaaaagaagcttcacaagatcgtaccggaagttttagacctttttgtcacaccgcttgtcagcgtattcgtaaccggataccttacactttccatcgtcggaccaatcttcgtatgggctgaaaatgcaatcctcggagcaatccagtggatgctgacacttccactcggacttggaagtctgatcatgggtagtttatatgcaccgaccgttgttaccggtatccatcagatgtacacagccatcgatatcggacagcttgcaaaatacagtgtaacctactggctgccactcgcaagtgcagcaaacgtggcacagggtgcagcagcacttgccgttgctgtaaaatcaaaagaccaaaagatcaaatcccttgcacttccatcatcactcagtgcatttatgggaattacagaacctgcaatctttggtgtaaacttaagattctttaaaccatttatcgccggatgcatcggtggaggatgcggagccctttatgcttcccttgttcacctcggtgcaaaaggaacaggtgtaaccggtatcttcggaatcctgctctgcctgaaccagccacttcagtacgtcattgagatggcaatcgcagtcggtgttgcatttgcagtatccttcgcactttacaaagacaagaagaaagaaccagtcgcagaagctcctgttactgttgcagcttccgtagaggaaacagacagcgaagaatctgctgcttccgaaaccaaaacagcttcaggcaatacaaaaaccacttcttccgaagaagtgttaaatgctccggtaaatggaaagatcattccaaatgatcagatcgcagacgatacatttgcagcagaagtccttggaaaaaccgtagcaatcgaacctgctgacggtatcatcaccgcaccttgtgatggcgaaatcgtaagcatttttgataccggtcacgcagtatgcatcctgactgacggcggcgcagagcttctgatccatgtcggaatcgacactgtaaaaatggatggaaatggatttacaaagaaagtatctgacggtgcaaaagtacacgccggagacgtgctgatcgaagcagatttaaatgcaataaaagaagccggacatccggcaacaaccatgatgatccttaccaatacagatctgtatgattctgtagaatgtgccgcacccggcactgtaaccggtaaatcatctgttatgaaacttacaaaataaaataactcatgacaaataatcagatttgtctcccgcagcgggtgtcggaatcaatacgttttccgaaccgttgcctgcggaactatttccaggagtgaatcaatatgaacgcattaaccagagattttgtaaacttagtaaatacagcagaagagaaccagacagcaaaagaacagacatccggcacacagttccgcgagaagctgcacctgatgcctccggttggctggctcaacgatccgaacggactttgtcagatggatggtgtgttccacgcatttttccagtactccccatttaacgccgaaggcggtgtgaaaatgtggggtcattacaccagcaccaatctgatcgactgggaatacaaaggtgtatccctctacccggatcagccatttgactgccacggtgtatattccggatctgccttcctcgaaggcggtacaatgtatctttactacaccggaaatgtcaagctggaagatggagattttgattatatcaacaccggccgtgaggcaaataccgtactcgtcacaaccaaagacggaattcattttggcagcaaaaaagagctgctccgcaacagcgattatccttctgacctgacctgccatgtgcgcgatccgaaggtctggaaaaaggacgatacctactacatgatccagggcgcacgtactaaaaatgatgtcggtcaggcactgatttttgaatcctccgataaaataaactggcacttccgcagccgtgtagaatccgaaaagcctttcggttatatgtgggaatgcccggactattttgaaacggacagcatcaaaatcctttcctcctccgtccagggcctggaaggcaaagagtgggctgaccgaaatgtataccagtccggttacttccttgtggacggcgacattttagattcctacaaattatccccatatcatctgtgggattatggttttgactattacgctccgcagagcttcgaagcagaagatggaagacgcatccatatcagctggatgggaatgccggattgcgaagaatataccaatccgaccatcaaagacggatggcagcactgctttacatttccaagagaagtctttataaaagatggcaaagtctgccagaaaccggttcgcgagctggatgcaaaaaagcaacagcttcaggatgttcagaatgaacttacccagagcagctgcccggtatatgaagtaaatgtagatggaattaaggagaatcatttccaggctgtcctttcagatgaactgatccttgactatgagaatggacggttccagatgcatttcacaaacaaaagtaaaacttccgtatccgcaggcagaagccttcgctacgccgaagtcggcactctggaaaatgtaaaaatccttgcagatacttcttccgttgaagtatttgtaaatgacggagaattcgtattctctacaagatattatccaaatgattataagattgtggtgcattccccaagtgcccacattacattcgataaaattcagtaaatcgtatatgggaaatctccccaagcttcccgtatacgaaaacgccagacggggtacagcaatcccttttcctcctttgcatgctgtatcctgcctggcattttttaattctgattgttacacaatttttaattctgactgttacacaattgcttctataattgtctttccgtcaattgtaatttctttgataccggtttcttttttcctgttaaaattaaagctgatcatatatcctttcttcacatggtaatcattaagatattctatcaactgattctccccacgattattatattcctttccatgccagatcttcatttcgataatatactgttcacccaaatagtctacaataatatctgtccgtttctgctctctggtttgagtctctatataataattgcctgttccattgataatcggtcttaaatacaaaagaaaatattttctaccttcatcttcaagaaatgtctcgtcactgtcgccatataaatcatgaaaatgctgcacaaatttttcaaggaccaatctcatattcaaataaccatttgtgataaactgattcttgtcaatcaacgatgccgcatagatttcctttttctgcatctccgcagatgacaaatacagattatataaccaggtttcaaaaatacgattggaaactgcaagcactccattttcatttttcacaaagccgaacatggtcgcaatattgattgatgtctcataataattatacacaatcgcttttcccgtaaatagaagtgaatagagcatactattcaattccggatagctttccagtttttcacgcaaagactcaaacagcatatttttttctgaaagtaaaatccttaccgcttccaaaaatcccttcttcgtccacgcacttttcttaccaccatactccttcttcgcactgatttcctcatccaggagctgacatatcctcgacaccaggaatggatatccggatgtatactctctgatcagtccggcaagtaattccacatccattcctgtatgataatctttttcatactcatcgagcattcctgcaatttcttctcttgaaaagctcatatccactttaaaatccgctgcgatattccacggactgttatatttatgaacttcatccggacggattttccgccttaaattctttacgtcatatacacccgccaaaataacagctcgaaatgtcggctgtatatctctttcaatatactgagcacgaagctgagcaagaaaatccagaaacacctgattattcgatgcactgtcaacctcatcaatcatcagtacaatctttttttcagctgccgcacagagatcactcaactgttcaaacagctcttttaaggaaaaatacttatctgtataatccgtactatgcaaaatattttttatcgcatcttccagttctggtgaaagagtatttctttttaacgaccgcaaaaatgaattgataaatgctgccgaaaaaacgtttccattttcaaatttatcattgtcaaaagtctgaaaatccagaaggacaacataatattctttttgcagatagcgatacaatgcacgaagtgttgttgtctttccatattgccgtgcacggttgatcgtaaaatatttgccggcatctacgaggcttttgatctcctccagccgtccggatatatcgaccatataatgttcttccggtatgcatactgctgttgtattgaatacttttggcatcgtcttttcaactccttttcgcaccactgtttcttagattttatcattgcggtgggggaatggcaagggattctatctttcagttttcttctccaccttttctttttttatttcaaatgttatacttcatatacagcaaaaaacagataaaggtaacgaaacactatgttaatcagaaaaacacttccagaagatgtagacacgattttaaatatttttgacaccgcacgccagttcatgcacgcaaccggaaacccgacacaatggaatgcaaattatcctgctctcgaagatctcgaaccggatatccagaatggtaacagttatgtctgcgtagaaaatgataaggtcgttgccacttttacacttatcatcggagacgagccgaactatcaactcattgaaaatggaagctggcgttccgaggctccatacggaaccgttcaccgccttgcatctgacggaacaaccaaagggattgcacgggcttgctttgatttttgcaagacacaaatctcacatctgcgtgtagatacccacaaggataatcaaccaatgcaggcttgctttaagcagaatggatttgaagaatgtgggattatttacgtcagtgacgggactccgcggatcgcttatgaatttattaggatatctgaatagaggggtatttttatgacaatcatgtttcgtgtagatataaaattttatctacacgaaacatgagatatggcgaatttacttatgaactgttttctattataatggaggtaagcaatggaaaaacaaaagaagaaatctcgccatagcaaacacccccacaaccggcagtataaagaccggttatggagaatgatctttaataacaaagaagatctgctgcagctttataatgcgatcaaccacacggactatcagaaccctgatgacctggaagtaaatacattggaagatgtcctttatctgtccatgaaaaatgatgtatcctttttggttggcggaaccatgaatctgtatgagcatcaaagcacttttaacccaaacatgccacttcgcggagtcttttatttctcccgattatatgaagggtatgttgcagataataatctgatgatctaccacgaaaaaagcgtccggcttccaaagccgaaatatattgtcttttacaatggtacaaaaaaccagccagattccatggagttaaagctttcagactgctttgaaaatacagataacgaagcaccttgcctggaatgcaccgcaaccatgttgaacatcaactatggtcacaaccaggaactgatgaagcactgcagaaggcttgaagaatattccatattcgtccaatgtgtcagggaatatatacagtcggaaccttctgtggaagatgcattagaaaaggcaattgatacctgtattcaccaggatgtgttggcagattttctcaagaaacatcgagcggaggtgacgaatatgatcctgacgacatatgacaaagacttatatgagaaaaccttgaaggaagatgccagagaagaaggtagagcggaagggcttatggaaggacgcgctgaaatcagagcagaattaaatgaattcaaactactaaacaaatgtctcctaaaagccaaacgctacagcgacctcgaacgcgctaccgaagatatcgaataccaaaagaaattattaaaagaatttggcatcgaataaaaaataaataacccttacccccatcccgtgactgatcaccgtctaagatgcagtgcatctccccctatatcagtcacgggatctttttgtccggaaaatccctctccctcaccgctataaccagatcactccttttctatgcgctccccgcaatctatactttttgcacttccatcacattattccccacttttacttctattctaatatcccaatacatatagtagagtcagacacaaatattacacactcctacaaatcctgatgttggggttcaaaggtattttgacccctttgataccagattgctacgtgctttgcactctcgcaatcctcaaaagcattcgtaatccgctcatttttctttgaaaaatggctacttactcatgtttttggcggatcaagaggtcaaaaatcctcttgcaagcaagcttacatcggctttctgaccttttgcccctggtatcaaatcattatattattacaaaaacattactatttcttgttatagcttaaaaaagttaatattttccgttattggtaatgattcacgtaatgctttgtcagatacaatacctatataagataaaaaagtctaaataattaggaagggcagatgaaaactgacatgaataaaaagcaaaaaaatacaagaacttttttaataaaaatcatggatcagcagaacggtacctggcagggcagcgttacttgggtggaagagcagcgagagcagcatttccgcagtgcccttgaattattgaagctgatagacggagcacttgataacaattatgaagtcagaattgaggaatagaaggaggacgccatgaaaagtaatacaaagaaacgtttaatagcattcatgctttgcatggtattagtgcttagcagtacgatatcagcatttgctgatgataatgtggatggatttaatgacaagataggctgccaggccatgacactgacgcaagaaatgaaaaatgcggatgatcagacaataggcactgtatatgcagacattcctgaaaatgctttctatctagatgatccgtcagacgaaattacgatggatctagcagaagttgaaaatgaggaaagtattctagatgcaattcagagcaatttgaaagaacatgaagcacttacagctgcggtcatgtgtaaggttgattttaaagtaaatggtgtgtcatcagaacctaatacaaccattgcacttcgctttgaaaatctaaatatgaatttagaaaatgcaactgcttttagccatgatgcttcattaaaaacaattgacaaaacagtagttgcagccggagaaggtcaggcacttcaaatctcggcagataaaaaccagatttatggcttctacacagcagaaactgtagcagaagaagaaaatgtagcagaagaagaaaatgtagccgaatcagaaacagtaacctttaataatgatgctatcgcaacagcggcaacaggtacttctacttatacaatagcagcaacaaaacagcttcaggtgcatgtgacttaccgggtaagcgatacgaaaacaaaactttttgccggcaagacttatacgttgaacaaaggaggaacactgaaccttgcagctcagaagagtgacaactatacatttgcttccgtatataaagcagatgcagatggaaatgccacaggaaatgcattaactctgatacaagatggtcagattgcagagacgctgaatgaggatacaaattactgtgtattctatcaggcaactacggatggcgatgtcagcggaaatgttacattttatgattatcagatcaatccaccatccggacagaagagcatcaatgatccatccaactacgttgaagcagcagaaagcagagaagtagcaaaagacagacgttttgcaatgggtggtgctgatagatttagaaagtctggagaagattattctgtatgcaaaaactacaatgacggacagggcgatgtagatatcaatgaatgggctcaagctcgtgactcttatatttacaaagatattattaacggcgtagatgtaagtaccggagccctggatatgggtacaaataaaaatggtgacaagattgtagaaccgggactgtttacaacaacaaatgccggagacaaacttggaaaacagatttatacagactttaacctgaaatttaaccggacaggtaatgagtatagactctccgctgttaaaaacggtagtcaaaccgttgtttacgacatgagtagtttcttcccgttggatgcttacaaagaaaaagaaaaggataacgttgaagcattcgatgataaaaatcataactattactttggaatgcgttatgatatccagttcagattaaaagactatatcggagcactgacttacagctttactggtgatgatgacctttgggtagttatggatggtaatcaggttgtggtcgatgtcggtggtattcatgaccagatggatgaaaaagtagatctgtggaccgttcttcttggaaagccgacctatacagatgcggaaaaagaagcttatgttacagaccatggtatggagacacatcgtctgacagtactgtatctggaacgtggtgcatataaatcaaactgtaagatgacttatgtacttccaaacagcagtatcgtaaatccgggtgagattcagaatacaagccttacttttacaaaaacagatgctgaaaccaaaataggtctggaaggcgcagaatttggtatttatgatgatgaagctttaaccacatcacttggaacattaagaagtgatgaaaacggaactgttacattgagcaacctttcctatggtgacgtatattatctgaaagaaacaaaagctccaagcggttatgtggctggaaatactgtttataaagtagttgtaaaatctcagggcggtacagcaacagcaaaaatgtttgctgtcggtgataaagatgaaactgctgtgacagctgttccgaatgccaaagcaaattgggaacagtcaaaaacagcacaactggttgattggaatgcccgtacatatgatatcacactcagtgcatcatcactggtgaagacagccgagacaaccgaaagaccggtagatgtatcacttgttatcgatacttcaggaagtatgcgatgggatgcatcttatgagttgattggagaaaagaaactttcagagctagataccagtaaaacgtattattattgtagtgataatagttggtatgaaatgaaatataggaggtcaggctggtatagtagatatgctggatacaatgacaaagagatggactggtcatataaaggaaataaaaattccagttctaaatatacggtatacagtaaaaaggacaatgagaaaagccgtattcaggcagtaaaggatgctgcaacgtcctttgtaaacaatttgcggacaacatctccaaacagtcaagtttctataactggtttcagtgacagggtaaatactaatacagcactgttatgtgtcggcgtggaaagtgaatatgatcggattatttcagccatcaatggattgggttctactggaggtacacgacaggataggggccttgatgcggcaaaaagcaaattgaaaaacagcactactgctgacaaatatgtggttcttctgacggatggaaaatcaaatgatccagatagtgcagttaagtctgctacagctgttaaggaagcaggcatcaagctgatgaccattggtgttggtctgtcaaatgaaacaaaggactggctggctggattgtcatctggcgaaggatattcctttaatgcagacaatactcaggaaatcaatcaggcatttgctttcgtaagtcagaccatcgaagatacgcttccgatttccggagctgttgtaagagactacattgatccaagatttgaacttgtgacatcaggaacagatattgcagctatgggcggcgagatcaagacagatgaaacaaccggtcagacttacattgagtggaacaatgcagttattggtaaaaaaggtacagatggtacaccaggatggagaaagaccattcgagtaaaagcaaaagatgcttatatcggtggcaacgatgttgttaccaatgggccggaatccggtattacagtcggaaccgatgaccggaagtttattcagccaaccgtaaatgtaaaagttgatttcgaagtcaataatggcgaaaagacgattttcaaaggtgacaaaccgggagactatattgatgaagcgaagctgaatgaagtaacaaagctgaaatcaacaacaacaccaagtacagaatatacaatgctggatgatgtgacaatcacaacaaaatggtttaaagatgcagcttgtacaaacgatattagtaaagattacattctgaatacaccattaacggaagaaactgtttattatgcaaaagttacagtaactccgaaaacagatggtacagcatcagcagcaaattccattggcgataagaatggaaactgtactcaagatggtaaaaagtattacgcagttgattcaaagggtgttacaaaagatggcatttacacaattaaacttgtttccggtgcgattaatattactaagaaattggaaaatgcaccagacactgctaaagaatttaactttacaattaccagaacagatgtaagaccgaatcagaaaattgcgactgttaaggtaaccgtagcagcagatcagacaacaggaacgcttgcaggtgatgaactgaataaagtttccaatcttgcaagaggaacttatgtagtaactgagaatgagacaagtggttatgatgtaaaaggaattcttgaaggcgaagaaacaaattgccaaattgctgctaaaacggatgacaccatcacatttgttatgggtagtgataaagatggaaaagatgttatcacaaataacacttatactaatccagccggaagacttggtgtggtagaatataccaatgaagaagtgacaagtggctggggaatcaaaaaaataagtgcaagcagtgataatccatacatctatctgaaaggtgcaaaatttaagctgacatcaacagcaaatacttccgtaacatattacggaaaatcaaatcaagatggtttgcttatatggtataacacagaagagtgtgcagatacagaccagattgcaacacttccaaaaggaacttatacaatggaagaaaaaattgcaccagctggatataaatgcagtactgaaaaatggcaaattcagattatgagaaacggtgcattaaagtccattacatcatctgtaaatggtacacctattaaaacagtaaccgaagaagtaaatggtaagaatgtgatatattatctttaccaaaacgaagctttatacgccctcccacattctggaggcaccggaatttacctgtatatgattggcggcatgttacttatgttcgcagccgtatggatcttatataaaaacaaatgcaaggaggtgctgggaaaataattgtaagaattaatttttcagtggcttcttgccacacaaaaacgttattatcccatatgaggggacaataaaaaatgggcaacgcccttaaatgaaaaggagacaaaaatatgaagaagatgagaaaaatctttgcagtgttattaacactggcaatggtgctcggaatgagtatgacatcgtttgcagcaaaagatggcgcaacgcttgaagtaaaaggtcttgcaacatatgcagaacagaaagtagatatctatgaaatctacaaattagatgccaatgataatggctgggaagcagcagcttggacaaagggaacaaatgtaacaccagaaacattagctaatgctgatatgattactgcattaagaaaggcagctctgaagacaacagctactgctacaaaaaaatctacagagatttcaacaggaaaatttactagcaacgttacatttgataagttacaggcaggtgcttatttagtaattgttacagattctgctaataaaacagaatacagcacaatggtagcaaaaacgtataagtatgatgaaggtaacaatctgattgcgccattaagtgcatccgtagttgcaaaagcagataaatatcatacaggcaaagaggcagataaaacaaatgttgaagttggagatttagttacatataaagtaaaaacaacagttccttatcaggaagtaaaaccgaatggtgacaaacttgtaaaagaattcaaggtatctgatacattaacaggtgctacattctaccttaccggagaagcagtaaaagaaacagcagcagttaatacaattactgtaaatggagaaacagttactggattcgaaaaactgcctgaaactttaaatggacagaatacgtttacacttgatttaatgaatcttgtagatgcaaataacacatatgcaggtcaggaagtagttattacatatacagctaaagtattggcagctaatgaggttagcaatagtgctacttctacacaggatccgaatggtacaactacaaaaacatattcaggtaatgcaactattaccaaatatgatcttggaaagaataacaaactggaaggtgctcagttcgttgtttacagaaaaaatgcagataacaagaaagagtacgctgtaatcggagatgatggatggattacaggtcagtggattgaagagacaaaagatggtaaagtaccggagggattaggtcaggcacttactacatctaataagaaaggagatacttacggaactgttacagtaaaaggtcttaaagttggtgattattacttccaggaggtagttgctccggatggatatagcattagtactcaggatacagcattcaaaatgattgaaactaaagatgctaagaacgtagttactggtgtagtagcaaaagagcctcagaacatttttatggtggatactcagatttctcagcttccatcaaccggtggtatcggtacaacaatcttcactatcgctggatgcctcatcatgatcgcagcagctggcttattcttcgcaagccgcaaaaaaacaaacaaataatctttcatgattatttataaccagatatggaatccggggcacttgccccggattcataaaaaataatacaacagcaaggagagttcggatgaaaagcaaaacaagcaaattaatgattggaatcatatttttagccggtttgtccttactgctgtatcccttcgtagctaatcagtggaataactacagacagaaacaattgatcagcagttatgagcagacagtatctcaaaaagaagcatcaaacggaatcgactatgatgcagagcttaagaaagcagaagcctacaacgaagccttacttccaagtatccttcctgactcatttgcagtagccgcagccagtgacaaagaagaccagtcctacatggatgctctgaatattgccggtgacgagatgatgggaatcgtggagatcccgaagattgacatcaagcttccgatctaccacactaccgacgaagatgttctcaaacaggcagccggacatctggaaggaagctctcttccaatcggcggtaaaagtacacacgccgttatctccgcacaccgtggacttccgagtgcgtctctttttaccgatctggatcagctggaagaaggcgatcattttctgatccatgtattaaacgaaacattatgttatgaagtcgacaagatttccgtagtaaaaccggaagaaacttcctctcttgcagtagaagaaggaaaagatcttgtaacacttttaacctgtactccatacggagtcaataccgagcggcttctggtccgtggtcacagagtaccttatgtggaacagaaagttgccgatgagaagacaccgctcagcggaatcagtcttcatacaaattatcttttatgggtaattattggtcttgtaattaccacaatcttcatccttatgttatacttaaaggagaagaagcttcaaaagaagaaaaaagagacctcttaaaaagagaataagaacgagaaagggaatatgcctatgaaaagaaaaatctcaaccttccttttcggtctgttattcttgataggatttgggattctgatctatccgatggtatccaaccagtggaacacctacagacagaatcagctgatcagcagctatgacaatacaatacaggacatggaaccggaggacttcacctctgagtgggaaaaggcaaaagctttcaatgataccattcagcagaacaacctctacggagatgtattcggtgaagatgaaaatgacatcaaaggcaccgaatactggaagatcctgaacgttgcagatgacggtgtaatgggatacctttccattccgaagatcaatatcaagcttgccatttaccatggtaccggtgatgatgaacttcagaccggtgtcggacatctgaacggcacaaagcttccgatcggaggggagagtacccacagtgttctcgcagctcaccgtggacttccaagcgcaaagctttttaccgatatcgatcagctcaaagttggcgataaattttacatccatgtactggatgaagtccttgcctacaaggtagatcagattcttccgatggtagacaaagacgatcatgaaacactggagaaagcactccagatagaagaaggaaaagatcaggtaactttatttacctgtacaccatatggagtcaactcccatcgtcttctcgtaagaggaaccagagttccatataacggcgaagaggatgctaccgaatcagttacagattctatggtaaaagccattcagaattattatatgctctatttaattttaggactttcaatcacgattcttgtgatcattctcttgcgattcctttccaagagaaaagctcacaaagaataaccaagatttttaaggaggacatgaggcgatgatgaataaacgattaaaacagggaagtacttttctcttagctctcgctcttgcatttccgcttctcactctgcctggtgccagagctgcgaatgcgattgagacgaaccgaaagtgttcggttgcattcagtgtaagcggagaggacaacgaactgacagctgccggcactgacattacagtgaatctttataaggtggcagatgtagatgtatccggtaactataccgcaaccggagctttcaccggacttgatgtatcttcggtaagggctgataataacgatgcagcaagcgaatgggttgagcgtgcaaagaaagcaaaagaaaagctgagtgattccgtaaaaccggtcgctacagttaccttaacaggtggtatcggaaataaagatggtcttgataccggactttaccttgtagatacaccggaagtagttaccacgaattatacctatacctttaccccttacctggtatcacttccgaccaacaattattacagcagtggtaacgatgactggatctacgatctgatagctaccaatgcaattggtctgaaaccggaagaacatgcaagatatggtgatctggtgatcaacaagacacttgcaaatcacaatgcaacaaccggtaagaaagcaaccttcgtattccagattgatattacaccacttaagagtgataaaacagaaacccgcatcgagtcccttgactttgaagccgcagggaactcttccgtaacaattacaaagatccctgcaggagctgcggtaactgttaaagaagtgtacagcggtgcaagctacaagcttacctcagcaaatgatcaaaaggcaaagattgtagcaactgatagaggtgcaaaagtcgattcgacatccgtttcatccgtttcatttaccaatgatatcgataacaatatgaatggcggctacggtgtaaaaaataatttcaagctgaacgaaaatggtcagtatcagtacaccgaaccggcagaaaagaactaggaagggggagtcggaatgagaaagttacataaaaaaccacttatcatggcaacagcaacacttgctcttaccggaaccctggcagttggaagtgcaatggcatactttacaacttatacgacagccggtggcggtgtgacgatgaatatgggatttaccaaaaccatccctaacgaaacagtcgataaagatggcaagcacgtcaccattacaaataccggtgattatgattgcttcgtaagagtaaaagcatttgccccaatggaacttacctatactgctccgaatggcggatggaaagccaaagatgatggttattggcactatgaaagcgttcttccggcaggcgaaaccacaccgaaactcaatatctcttacaaattcccggaagggaaggataaaccggaagaattcaatatcgtggttatccaggaatgcacaccggttctttacgatgaaaatggaaagccatatccagactggaatcatgtaatcacaactgagacaacagaagacagtaaaaccacagaataggagggaacgaagatgaaaaagaaaaagaaatcatttccaaaaaaatcggccctgcttctgacagcatcagcgctcctgttgattggcagtactgtcggcagtacacgtgccgcactcacctactacagtgagaattattccgcacagatcgagatgcagaatatcggtgtatctcttttagagaatggcgatgtcgtcagcagccaggattttacatctaagaaccagaaagaagtaaaagacggggaactcctgacaggccttctcggaaaagatgaaaaattcgcacctggaaagaaatacaaagaagagctcagtgttcagaacagcggtaacatcgacaccttcgtgcgtgtgatccttaccaagagctggcaggacaaagagggcaagaagaacaccactctttcaccagatctgatcgaactgaatttccttaccgctaacggctgggtagttgcagatcagcagaccacagacgaaagaaccgttctttattacacaaaggcagtaaaagccggagataccacaccggcattatctgacacactccgcattgatccaaagattacaacagatgtagagaaaacagtaaaggacaaaaccatcacttatacttacaagtacaatggttacaccttccacattgacgcagaggtggatgcagttcagacacacaacgcaaaggacgcgatcaagagtgcctggggcgtggacgtgaatgtatcagacgacgaaacaacaatgagcttacagtagggaggtacagagtatgaaaaagaaaattttgtgcctcgccatgacagtgataatggcagcaggggtacacacaactgcatttgcaaaggattatcagggagccgacggatggcaggttcatttcaccggcgacaagatggaaagcaattttgaaaacaagactgtttccgatgagctggcaacgatccagccgggtgacagcatcgaattgaaggttcagctgaaaaactccgataaaggcgagaccgattggtacatgaccaatgagatcatccagccactggaggaagcacaggaatccgctgaaggcggtgcttacgaatacaagctgacttatgttggaagtgacaataccgaaaaggtactctataacagtgataccgtcggaggtgaaggttcttctaagaccggtgaaggtctgaaggagcttggaaactctaccgagaaatatttctacctcggtcgtcttgcttccaatggtaccggaaccgtacaccttaccatcggtatcgaaggtgagacacagggcaatggttatcagaacacgctcgcaaagcttcgtatgaactttgcagtggaaaaggtaaaagtaagcaataccattaccaagacgaaaatcgtcaagactaccaacaccgttaagaccggtgataccgcaagagttcttctcttctgtgtgcttgcactcatcagtggactgatccttctggcatacggaatctacacatataacaagaacacaaagaaacgcagacggaaaggagagtaagcagatgaaaagatggaaaaaattactggtttctcttctgactgtatcaatgacgatcggtgcatccacgatgagcgttatggctgctaacgggtatacctataaggtaactttatctgcaggtaataaaggaacgataaacggccaggctaaggaggagcgggattctcttgtcgccggttctactgttacttttaatctgaaggacgttcaggtaaccgatgacaaatactatgtcaaaggaatccgtctcagcggacgtgacaatgaagaagctcttgcttctcctgtattagacaatgtaaccggcgatgccgactatgtagtagcctatggaatcaaaaaggacatggttgcctacaccgtaaactatcaggatgcttccggtaaggcgcttgcagaaagccagaccttctacggaaatgtcggtgacaaaccaatcgtcgcttatcagtatattgaaaattatattccagatgctcttgcacttaccaaaactttgagtaataatgaatctgagaatgtatttacgtttacctacaaaccgggtgctacagaccgtgttgttacaacaacaaccaccatcacaacgactgttcctggtacagcaactcctggcacaggtaccggtaatgtcggtacagcaggtggcacgacaggcggcacaaccggtggaactgccggaactaccggtggcactacaaccggaactaccagtggcactacaaccggaactaccggtggcacaacagacggaaccacaaccggtacaaccgatggtacaatgacagataacaattctcaggatacgacagctaaagataaagatactgcaacatctgaggatgaacagacaccaaagtctctggtagatctggatgatgaagacactccaaaaggaaatatcgatgcgaaagacaagacgagcaagactccgatcgcagcagggatcggcattatcgttgttgcggtagcagctctcgcaggactgatcgtattcttgaaaaaacgtgcaaaataaaaaaagcgcggcactaaaggagaagtcttttttgaagagaacgaagaaaaagaaaagcccggtggctgcattttgcagtgcactgggcactgttttactgacagtactgattcttgcctgtattccgctgacgcttccgaaagcttttggttttcagatgtacaccgtgatcagtgggagcatggaaccggcgatcccgacgggaagcctggtctatgtccggtatgaagaaccagacacgatcgtcaaggatgatgtcattgctttttacagcaacaatgcagacggctcgatcatcacccaccgtgtagtatccaacagcccggcgatgggacagtttatcaccaaaggggatgccaatgaggaaaaagatatgaatccgatcccttacaacaactacatcggaaaagtaaagctttctgttccggttgtcggcggtatcgcacaggctgcaaccggcactgccggaaagattgccgctgcatctatcatcggtcttgctgtgattcttgaaatcgttgctgccatgcttgacagacgcgatgacgaagacgaataagagaaaacgtttttcattttagcttgctaaagtgtgaaacatttgctaaaataatatcagattgtattgtcagaagaagatgggggaatttcacaattctcccatttgtcatatattgaaaagaatggagaggtgaatggattgttatccaaccagattttacagagaacaatcaatgaaataggggatatcatcgagtgtaactgttccatctggaacacagacggagtgatgcttgcagctgtaggtaaggagaaacctgcagtaaaaaaagctgtctgctcatttttaaaagagctggaggttaccggcgtatcggaggagcacctagatgaatgctatggtctgtttccggtttatgatgataatgaactgacttatattttcgtgatcgagcacaataatgagattgatgtgcataccagcggacgcttaagtgtctgccagctggagagccttttaagatccggaagcgaacgtcttgaccgtaaccgttttatccagaacctgctcctggataacctgcttctcgtagatatctacaatcaggcgaaaaagcttggtattacagtggagcagcgcagagtcgtctatctgatcgaaccgaagaatccggatgacacgatcgtcctggatatgatccgtggaatttattcctcgggaaccggtgattttgttactgccgtagatgagggacatattattctgatcaagtcccttgacagtacggatgattatgatacgatccgttcgactgccgatatgctggtgaatgcgatcaacaccgaagctatggtcaatgtccggctttccttcggaaccatcgttcctgagctcaaagaggtctcacagtcttacaaagaagcaggcatggctctggatgtgggacgtatcttctatccggaacgcaatattttatcctaccgcgaactcggtatcggacggctgatccaccagcttcccgtttccttatgcgagatgttcctggaagaagtatttgccggaaataccgttgatcagtttgacgaagaaaccttatccacagttgataaattttttgaaaacagcctgaatatttcggagacagcgagacagcttttcgtccaccggaatacgctcgtctaccggctggagaagatccagaagcagaccgggctggatgtcagagtgtttgaggacgccctgacatttaagatcgctctgatggtcgcagaccacatgaaatttatagaaaacagaaaataggaggacatgatatggtgaaattatacgaaggcggtgcctatcttttacacggtactgaggtaattgcagatgcacccgatgcacttgctgccgtaaaaagcaaaacagggattgagacaacaaaagaagctgctgcaaaagagacaatggcttatgggatcttaagtgcgcataatacttccggtaatatgcagcagcttcagatcaaatttgacaagctgacttcgcacgacattacctttgtcggaatcatccagactgcaagagcatccggactggagaaattcccgatcccgtatgttctgaccaactgccataactctctgtgtgcagtcggcggtacgatcaatgaagatgaccacatgtttggactgacctgtgcgaagaagtacggcggtgtctatgttccgcctcatcaggccgttatccaccagtttgcccgtgaaatgctcgcaggcggcggcaagatgatccttggttctgacagccacacccgttatggtgcactcggtaccatggcaatgggagagggcggaccggaacttgtaaaacagcttctgaacaagacttatgatatcaagatgccgggcgttgtcggaatctatctggacggcgaaccggtgaaaggtgtcggaccgcaggacgttgcccttgcgatcatcggcgcaaccttcggcaatggctatgtcaataacaaggtcatggaatttgtcggacctggcgttggcaaattaagtgcagacttccgtatcggaatcgatgttatgacgacagagacaacctgcctttcttctatctggagaaccgatgacaagatcaaagagttctacgatatccacggaagaagtgatgacttcagggaactgaatcctggcgcagtcgcttactatgacggtcttgtatacgtgaacttgagtgagatcaagcctatgatcgccatgccgttccatccgtccaatgtctacaccatcgaggatgtcaatgccaaccttgcagatgttctccacgatgtagagcagcgcgcgctggtaagcctggacggtgctgtggattactctcttcaggacaagatcgtaaatggtaaactttatgtcgatcagggtatcatcgcaggctgtgccggtggcggttttgaaaatatctgtgctgccgcagacatcatccgtggcaaatacatcggatcagatgaatttaccttcagtgtttacccggcaagtacaccgatctacatggagcttgtgaaaaatggtgcggttgctgacctgatggaagccggtacgatcgtgaagactgccttctgcggaccgtgcttcggtgcaggggatactccggcaaacaatgcattttccatccgtcactctacccgtaacttcccgaaccgtgaaggaagcaagctgcagagtggacagattgcatctgttgcccttatggatgcacgttccattgccgcaactgctgcgaacaaaggtttccttactccggcaacagattttgatattgaatacaagaacccgacctaccactttgattccagaatttacgccaaccgtgtatttgacagccacggcgttgctgatccttcggttgagatcaaattcggaccgaacatcaaagactggccggcaatgagcgctcttcctgagaatctgattctgaaggtcgtatctgagatccacgatccggttacaacgacagacgaactgatcccgtccggcgagacttcttcttatcgttccaacccgcttggacttgctgaatttgcactttccagaaaggatcctgcctatgtaggacgcgcgaaagaggtccagaaagcccagaaagcgattgaagcaggtacttgtccactggatgtactggatgaattaaaaccggtgatggcagcaatccagaagtcttatccggaagtcggcaaaggaaatatcggtgtcggaagtaccattttcgcagtcaaacctggtgatggttctgcccgtgagcaggctgcttcctgccagaaggtcctcggcggctgggcgaatatcgcgaatgagtacgcaaccaaacgttaccgctcgaacctgatcaactggggcatgcttccgtttattaccgaagaggaacacacaaagctttctttcaggaacggtgactatctcttcgtgccggatatccgcaaagcagtagaagataaagcttccacgatcaaggcttatgtcgtaggcgatgatctgaaggagatcgatctgaagctcggtgatctgacggatgcagaacgtgagatcatcctcaaaggatgtctgatcaattattacagaggttaatttttctcagacaatgatatgatttaaaagggacggaaatttttctgtccctttttgcaacacttccgacttttttatactcttatatacaaagaacctgttatgagaggagggactttatgatcgatgcaattgcatttaaagaattatataagacggtttatcaggatctgtatcgttttgcgctctgcatgatgcatcatccgcaggatgcagaagacgccgtcagtgaagccgttctttccgcctatgagaacatacataaattacgcaaagaagaagcattccgttcctggatctttcagattctggcaaatgtgtgccgccggaagttaaagagccgtgaacggaccgagaccgagctgaaagaagatcatgcttctgccacatactgtgacggactccgcacagatgtcgaacgtgcttttcttattctcgatgaagacgatcagctgatcatcggcttatccgtctatggcggttacaacagtaaagagatcggaaaaatgctaaagatgaacccgaatacagtccgctcccgcagaaagcgtgccctcgaaaagatgagctggcttctgaaagagtaggataaaagagtaataggaggtgtttcatatgacagatcacgaaaaagaaatactggataaaataaaacaatctacggaaaaaactcctgttccggaaagccttgcaccggatcagattatgaaaatgctggaagagcataacagcactcaggcttccggacatatcccgaaaaagcatggattttcccgcggctaccggatgcgcggaggacttatcgctgccgcactggtactggttgtcggcattggcgcccacatccgccagcagaatctttcttcagactcagccacttcttccacaaaaggcagttcttcaatcgatacatcctccggtaagcttgcctcttccgatactttagagacggcaaccgattatgatgaagtctacacatacctgcaatcttatcaggatgagttggattcttcatctgttaccggttcaaccgacaacggaattgttatgtattcaactgaaacagccgacagtggtgcacgtaccgatagttccagctcctcttcggattcttcaacagcctctgcacgtgctgtggatacttcattttccgatactaacgtccgcacagagggcgtcggtgaagcagacattgtaaaaacggatggaagttatctttatacactgaaagcaaactcacagaaaatttccattgtagatatccggtctgatcagatgaaggttgtttccggtatttcgctgaatgagaattttcaggcatccgaattttacctgagtgaccagaagctttttgtccttggcaacatgcagaacacgcaggttgattctgacagtaaaaccttgtaccgcggcagctgtacccgtatccagacttatgatctgacagatatcaataatccaaaatccatcggaaccgtggatcagagtggttactaccgcacttcacgttttaaagacggatatctgtatatattcagcgactattatattcacgatacgatcaccaaaaaagattatccttcctatgttccgcttgttggtgacaatcttctgaagcagtcggatatctatctcccgacgaaccatgcagcagaccagtaccttgttgtcagctccgtttccgcttccagtccggataaagcagcagaccagaaagccgtcatgtctgagaatggcgaagtctatgtgagtgagaacaacatttatatttacgagtatgcgaacagcagtatcctcgcagataatcttgcggcaaagaatcagacgatcctccgcaagctgtcttacaataaaggaaaactttccggctctgcccagggcaaagtaaaaggatatctgaacgattccttcagcattgatgagtatgacaatacgttgcggctggtgacaacggttacgcataatgtcggaagctcttcacagtccaattcagtctatgtgctggatgcagatttgaaaacaatcggtaagatcgaggatcttgccaaaaatgaacaggtctattccgcaagatttttgggcgataccggttactttgtaacttatgaacagacagatcctttattctccgtagacttttccgatccggagaatccgaagatacttggcaagctgaaaattcccggcttttcggaatacctacatttttacagtgataacctgcttcttggcatcggtatggataccgatgaaaatggcattacaaacggggtaaagatctccatgtttgatatcagtgatccttcggatgtgaaggaagtcagcaagtacacactggatcagtactattactcggatgttttttctgactaccgtgcagcactggttgatccggaaaagaatctgatcggctttccgctttccggatctgccaaccagtatgtgatcctttcttacgataaagatcagggtttccaggtacagatgcaggaggaagtcaacggtaattcttatcttggaacccgcggtgtgtatgcaaacgaaaagttctatgtgatcaatggaaatgcaattgaagcataccggatgggagactatgtgaagatagatgatctgctgctatagtgcagctttgcagaaggagctgccgctccgcatactttgtacaccattccacatcattgtatacacaaaaatcgtatataatcgagtaggctgactcctactcgattcttatactttgtacatcatctcgcttaacagctcgatgatgtacattcgccaaatgcagatccttgtgcaagcacaaatctgcacttggctcatcgtatacacaaaaacaggtgcccacggggatatatcactaagatatacttacgtggacacctgttttatattttcatttacctgttattccacaccgttaaagcagtaggtacatacctggcatgcatcaatcccgattgatttgatcagatcatccagtctgtgataacgaagtgaagtgaaattctgtctcttgcggatttcctccagcattgctgcataccggtcactgttcggatccgcatattcacccagtacattgacatcattgtcgccttcccactcacggatgatccttcttgtgatcagatccagatctgatttggaacgggagaagttcaaatatttgcatccgtacaaaagcggtggacatgccgggcggacatgcacttcttttgcgccactctgatacaggaactctgtcgtctcacggagctgtgtgccacgcacgatagaatcatcgatcagcagcaggctcctgtcttcgatcagactatgtaccggaatcagtttcattctggcgatcagattacgctgactctgtgttgtcggcatgaaggatcttggccaggtcggagtatatttgataaatggtcttgcatacggaatacctgattcatttgcatagcctatcgcatgagcgatacccgaatccggaactcctgcaacaatatccacgtcgatcgaatggtcatctctctgtgctaaaagctttccacagttgtaacgcatttcttctacaccaaccccttcataagaagaagtaggatatccatagtatacccacaggaacgaacagattctcatcttttcacatgcaggacttacagtctccacagattccggtgtcacgtagacgatttccccaggtcccagctctttgtaatctgtgtatccaaggttgatatatgcaaagctttcaaaggaaacgcagtatgcattttctttctttccgatcacaaccggtgtacgtccgagaaggtctctggctgcataaattccattctctgtcagaagcagaagcgtcatcgagccttcaactactgactgcacataacggattccctcaacaaacgaatcctttttacagatcaatgccgcaaccagctctgtagaattgatctgtccattggtcatagactgaaaatgtgtatgtccattttcataaagattccgaatcagctgatccgcattattgatcttacctactgtcgtaattccaaagcaccccagatgcgactggatcagaattggctgtggatcataatctgaaatacatccaattccaatatttcccttcattgtatcaacatctttttcaaattttgtacggaacggcgaattttcaatattatgaatcgctctcttccagccatcacttccgtaagtagccatacctccgcggcgggttccaagatgcgaatgataatctgttccataaaaaagatccagattacatgcttcttttgatgcaacgccaaaaaatcctcccatatctgtaggtctcctttctttatcccaatgccatagcctgtatttttcatctattttttagtgtatcatgcatttatgggcggaaacaatagcaaaaccccgaatatattgcaaatggctataactatttctaatcgtatttataattgtttgaattttctgatatatatgttgcaatttcaattctttctaattttataaaaattattttaaaattatattgacaaataagtatttgggtgttattattaagtcaatccaaaagaaaagaagttcctgacgagaaagggaatttcaaaaagatattttttaatctgttacatagtttcatatatactcgccaagagtataagatgaagaatcagatcagaaaagggtaacaagaataattgttatttgaaggttagaaagtttttaaaaagcaactatacattttggttatgagcgttttgtaagcggagtgtgtagagaacaatttttaaaattgataatttataataataagagaaaattgatatctgacttctgaacagaaaaaagtataagagaaaaagaatatccggataaaattttggaacgagaacgaaaggaaggaggctttgaccgttggatatttcatcatctaaaactcaatatgttaatggtatggcaaatgtaaattcctgtgagatgagccttaaccatagattataatccggtaagagaaaagttaatgataaaaaaggtcggagtagtagataaaccggaagcgattataagatataaaaagattcagcatttgttgacatattgaagtaaataccacagtaattcaagatcagaaaatgtgtaaagaaacattcattgataagtaaatttaacagtgacgagaaagctgataaataccaaaattggattacctgattatataaaataacgaacgatcagaattgatcaaaatcgattcatatgatttcatttttataaattttataaaatctgaatatcatatgaaatgctcaaagaacttacaggaataagaattacttaattcctccgatataaaataaaaattacaattgaatattccgagacagccatttaaaagatggctgtctcctttttttctgttaccagctcccaatttgtgaattttttgtaatatttttttaacatttctgaaaaatatcagccgtaatttttgacattgacaacgctctatgatacacttagtaagtaaaattataagacttttgttttccgtttctggtacaaaagtcagacttactgaggaaaagtaaaataattaataataatcatatgaggtgagaaacgttggataaatatgaatatcgcgcaaagacagagcagatgcttgcgtatgccgaacagaagtcttaccagaaagcgatgtcgattgcagatacgatcgactggcgtaaagtaaaaaataccgccatgctctctaccgtaagcgaaatctatgaaaatgcgggggaacttggtaaagcacgtgataccttatttattgcgtatgataaagcaccttccagcagaaaggttgtataccgcctgggaattatttctctgaagctgggacatttcgatgaagcagctgattgctacgaagaatttgtcaagcttgctccgaaagatccaaaccagtacattctccggtataagatcttaaaagcacagaaagcgccagtcaaagaacagattgaagctcttgaagatttcaagcattctgaatacgttgaaaaatgggcatatgaacttgccagattatacgctgaagctggtatgacttccgaatgtcttgatgaatgtgatgatctgattctctggttcagcgaaggtacttatgtataccaggcaatggaacttaaaatgaaatacaaaccgctgactccacttcagcaggaaaaatacgatcatcgaaatgatggtatcggccgtaaggattcttccaagagaaaaccttccttccgaaaatccaaagaacgtccggcaccgaatccacgaattgcagacaaggtccgcaaagatgtacatgtcacagacagtattgatcttccggatcttccagagccaatggcccggacacatgcttccgaaccagaagctgagtcacagccaaagacccggattcgaagcacttccgatatttccacaaccatttccggtgcttccctttcagatgccctgaaagccggtgttgccgttgcaagtggtgcagttgctcctgaatctgcttcagacgattcacagatgaccggtaagatgaagattgaagaaattcttgccaactgggaagcaacccagcgtgaaaatgcaaagattcttgaaaagagccaggaggaagctgagaaagaaaaagccctgcgtgagaagaagaaagaagaagaagaggaagttcttggagctacaaaaccaatcctttctgatgatatccgcaaactgatggaacagcttgaaaatggtgaagagcctaaaatcaccgatgaagatgctgaagatttcgttgatgatgaagaggatgaagcgactgaaagtccggaagattcatccaaagaagcttcagacactgacgaggaagagccggaagaaaatgattttgaagaaatcgttgactccgaagaagatgatgaatcggatgcggtttacgatgaagaagctgaatacgaggatgaggatgattccgagtatgacgatgacgaggaatacgaggatgaagatgattccgagtatgatgacgacgaggaatacgaggatgaagatgattccgagtatgacgacgacgagaaatacgaggatgaagatgattccgagtatgatgacgaagaagaatacgaagatgaggatgattccgagtatgatgacaacgaggaatacgaggatgaagatgattccgagtatgacgacgacgaggaatacgaggatgaagatgattccgagtatgatgacgacgaggaatacgaagatgaggatgattccgagtatgatgacgacgaggaatacgaagatgaagacgattccgagtatgacgatgacgaggaatacgaagatgaagacgattccgaatatgacgatgacgaggaatacgaagatgaagatgattccgagtatgacgacgacgaggaatacgaggatgaagatgattccgagtatgacgatgacgaagaatacgaggatgaagacgaagatgactaccagatcgatgatgaattagatgaagatcataaagaggattttgattttgaaaaagaatctactctcgatatcaatgatcatgattctgacaaagatgatggtgattttgcagaccttgattcctttgaagatgaagaagaattagatagcagtgatgattatcttgatcttgaatttgacgagaaaccggctcctgagccagagaaagaaacttcaaaatcagcgccaactccggatattgacgaagttcttgaaatcgaagaaccgtcagaagatgaaatcaccgaacgcatgggtaaattcgataccggattcgttgtacagggtcgttacgatctgagtgcaacaagtgagatcggactgaagcttggacttactgaagagcagaagcagctgttctcttactttgtaccgatccgtggtgtcagtgaacagcttgttgaaatccttgataacgacaaacgttgccgtaaccgttatggaacttcccgcacaggcaacatcctgatccttggccgcaagggaagcggaaaaacagtcctcgcagttgatattgtaaaagcaatccagaaacagcgcagactcaaacagggtaaagttgcaatcgtaaccggtgattctctgaacaaaaaggacatcggaagtatcatcgataagctgaacggtggcgcactgatcatcgaaaaagcttccaagatgaatgacagaaccatccgtgaactgaatgacatgatggatgaacagaccggcgaacttctcttccttctggaagaccagaagaaaccgctggaaagaatgtttgcatctcatcgcgaattcaaacgtaaatttacttccagactggagcttccagtattcatcaatgatgaactggttacattcggtcagacctatgctaaggaaaacggataccgtatcgatgaaatgggaatccttgcattatacagccggatcgatatgatgcagagagaagatcatgcggttactgttgcagaagtaaaagagatcatggatgaagcaatttcacattcccagaaagcaaatgtaaaacatcttgtgaaacgggtatttggaagaagcactgataattcagaccacatcatcctgaaagaagaagattttaaagcataagatttctacaaagaacgcgcttccggcgcgttcttttgttgtatatgcagacaaaaccgataactataaacaaagagttttagatatcttacataagaaatgtataagttgtccaaaactctttctttttatcgctatttctagtataatattcctaaatatctttgatagaaggtgaatgggatggcagtaaaaaaaacaacagcacaacagaccaacacgacccgcaagacggccgtaaaaaaatctactgtaaaaaaaccggcagctgctaaaactgctgctaaaaagtctacagctaaaaagtctgtaaaaactgtaacaacagataaacccgctgattatagaatcggcgaattagatcaatatttattcggacagggaacccattatgaaatctataaaaaaatgggtgcacattttgtaaaagatgggaaaaaaaacggcgtatatttcgcagtatgggctccacacgccagatcagttgccgtagtcggtgaattcaacggctggagtgaagatgcaaacgttatgaagcgtcaggaaccacttggaatctataccgcatttgttccggaagcacagctcggacagctttacaagtactgtatcgagacacagaccggagataagctttacaaagctgatccatttgcgaacagtgcagagttgagacctggaactgcctcaaggattgctgatatctcccatttaaaatggagtgacagtgtctggatgaagcaccgggcagaatgggatttccattcctcaccgatttccatttatgaagcacatatcggttcctggatgcgccatccgggacgtgaagatgaggggttctacagctaccgtgaatttgcgcatgcagctacagactacataaaaaagatggggtatactcatatcgaactgatgggaatttcagaatacccatttgacggctcctggggatatcaggtgaccggatattatgctccgacctcccgttatggtacgccggaagatttcgcatatatgatcaattacttccataagaataagattggcgtaatccttgactgggtaccggcacattttccacgcgatgcacacggactcgctgactttgacggcacagctacctttgaatatgcagatcctaagaaaggggaacatccggactggggaaccaagatcttcgattatggtaaagcagaagttaagaacttcctgatcgccaacgcactgttctggatcgaacattatcacatcgatggtctccgcgtagatgctgttgcttccatgctgtatcttgattacggtaaagaagacggtcagtggatcgccaacaaatacggcagcaatgaaaatctggaagcaatcgaatttttcaagcatctgaattccgttactaccggacgtaaccctggcgcactgatgatcgcagaagaatccaccgcatggccaaaagtaacaggcaaaccggaagatgatggtcttggattcagcctgaagtggaacatgggatggatgcatgactttaccgaatacatgaagctggatccatatttccgcaaaggcgaccactacggtatgacatttgccttaacctatgcatacagcgagaattatattcttgtattatcacatgatgaagtggtacatctaaaatgctctatgctcaataagatgcctggtcttggatttgagaaattcgccaacctgaaggtcggttatgctttcatgatgggacatcctggaaagaaacttctcttcatgggacaggatttcggacagctccgcgagtggagcgaggcgcgtgagcttgactggtatctccttgcagagccggagcatcaggcactccagaatttctaccgtgacctgctgcatctttacacacacaacaaagccatgtatgaacaggatacctgcatggaaggctttgagtgggtcaatgcagatgacagctcacgaagtatttacagcttcatccgtcattcaaagggcgcaaaaaagaaccttttattcgtatgtaacttcacaccgatcgaacgaccggagtaccgtgtcggcgtaccacgcggcaaacagtaccgcctggtactaaacagtgatgaattgcagtatggcggaagcggaaaagcccgcccggcagtatataaagcaaagaaacaggaatgtgatggaagaccatattcatttggttacgatcttccgccatacggtgttgctgtattcgaattttaacatagcaagtcaatgtaatctgcgcaaaatattcatcatacgaataattgattccaccaattattttcttaacatttcccggattcgttcttccagagtttcttctggaagaactccggttgtatatccacagatttttccatctctgtacaccacaaacgtcggtacgatctcaatgcctatatactctgcaagctctttcgatatatcaatatcaatcttatagaaaatccattttccctgataccggctggcaatcctttccacaacaggatacatcattccgcactttggacaccatgatgcgtaaaactccacaattaccggcatcctctgctttccgactgtattttcataatccttcgtgatcaatgcgatacccatacactttcctcatttctgccatctcaggctatgtaaaaaggactggattagtggcatccacatttcgggtttaagattttatagacttcctgaaaagaatttctgaaacagatcagctttttattaaatcttggattcttatagcaaaacccccgcatacaattctgaaaatgatgctttttccgcatatttgttccttcctgacttcctctttctacaatatatgcaaaaagacagccgatgtgcggattgctccgtatctgctgtctcttatattgccagggatcatcctacgcactcagcgcctttatgatctgcctgttgcattttattcaattgtcttactggcgcattgcgatcagtttatggatcggatgtccctgcccggaaaatttctcctcgtactcagtcataacattccctctgctgagtgtcggatcattgtgaagatcataggtcttcgccagaagtacccagcctgccaactccacctgctccagtgaaaagtcaaacagctctctgttgtctgtcttaaattcaacgactccgtcaaaggcaaggatcttgtcataccgctcaaaaaactgcttggaagtaagtctgcgctttgcatgacgtgctttcggccacggatctgaaaaattcagataaatcttgtcaatctctccgacagcaaaaacctccggcagatttgtcgcatccatacagataaaacgaatattgttgacatccttgtattcctcgtcattgtcaaagcgttccagcgcccgaagcagtacgcttgaataacgttcgataccgatatagttgatggatggattctcctttgcaagtgtcagaagaaactgtccttttcccatcccgatctcaatatggatcggattctccggattctgaaaagtctctttccaggtgccgcgatatctggtctcatttttaattacaaggggatgagctgtcagataagcatctgctcccggtacatttcttaacctcatatatctttctcttcctttagtgaaaatatgtataaccttatttattttatactattctgaaatatttgaaaacccaaaaatatattttataagttttgtataaaatattcttatgatattctcttattatttagtagatttttctaatttaaagtagtagaatatgtatgcattattaaaaatgtataaataatttctaagaaaggagtcggacaatggatcatattgttaaaaagctctccgaaatcgaacacgcagccgaagctgttgtggaacacgcggaactggaaaaatcagaactggaagaacgcattcaaaatgaacgcaatcagttcgacaaacaacttgaagatcacacccaaaaggagctgaacgatatccacaaaggattaaaccgtcagatggatgagattcttgcaaggcagaaccgtaagaaccagacagcgatcgaagaacttaaaaaagattttgaagagaagcatacggcatatgccgagaaaattgtcagacgtatcatagagggatagcatatgggaaatttacttgcatacagtggcatcgtaacaaaagtacgcgccatgcaggcgaaactgctcactgatgaagatttccagaacatcgccgcatttcatacagtaaccgaagttgctgcttatctcaaagaacatcccggatatcggaatgtccttgcagatatggacgaaaaccgtcttcaccgcggtgagattgagaagcttcttgtgcagtcactttacagtgattatacacgcctgtaccgtttttccggaatggatcagaaaaaattcctggagctttatctgaagcgctacgagatgaatctgatcaactattgtctgcgtattgtattcaaccactatcagaagccttttgatctggatcataagaaaatattcttcgacaaatattcggatctctccatcgataaactgatcacttcggggaatatcggtgagctggtggaaaatttaaagggcacagaatactatgcgccgttaaaacgtctggaaaatgcggagaaccctaccctttttgattacgatctggcactgaatctgtactattttacaaccatgtggaagaaacgcaaaaagattctgaagcataaggaactggaaattttcaccagagatgccggagcaaagatcgacctgctgaacctgcagtggatctaccgtgcaaaaaaatattacaacatgcttccgccggatatttccacactgctgatcccgatacactaccggattcatgtagatcagctgaaggatcttgtagaagcaccgtctgtcgatgaatttttaaagctggttaccagaacgccttatctgcgtcacaccgatactcagacaccagcgtccatcgagacgatttacaaagactgcctgtaccgtctctacctggcagacagaagaagtaacccttattccatcgcaaccgtgaatacctatctttttctgaaagaggaggagcttgataaacttacaactgtgctcgaatgtgttcgctacggacttcctgcacgtgagacattaacttatataggaggaacagcgaaatgattgttaagatgaagttcctgagcattaccggaccacgcgccgacatcgaccgcatgacaaaccgttatctttccaaatatgagatgcagcttgaaaatgcactcacggagctcaagacagtagataatctgatgccatttctggaaatgaacccttaccgtgatccactcgcaaaagtgacacagtttctgggatatatgaaagacatgccagcagagccatcctttgatcagagcgaagacgagatccttgagatgattcgttctatcaatcatgactacatggatctgcagcagcaaaaagaagaactgaaaaaaaagagagagcatatccaggcacgtatgaaagtcctggaaccttttacttctctggattttgacctgcatgagatcatgcagtacaaatacatccgcacaagatttggaaaaatcaatgtagattattatcaccggctggaaaaagcgcttcttgaagacattgatgcattatttctggaaggctccagagatgcctcttatgtctatggcgtttattttgtatcggatgctgatgcaggaaaggtcgattcgatcatgcggtctctccactttgaaaaagtcgatctgctggaagactttggcggaaccccgctggaagcttaccgaagcctggataaagacgtccagaatctgaccgatgaaatccaggcagtgaaggataaacgtcaggagatgttccgcaagaacgcttccagactactcggtgcaagaattcagctggaacgtttttccgataactttgatatccggaaatttgcagcacgaaccgagacagacgagcaggaagaatactatattctctgcggctggatgtcggaagaagatgccaatgcatttatcaaagaggctcagggagacgacaaagtttatatcgtagtagaagaggaccgggaacagtattttggagaacctcctaccaagcttgagaatccaaagcttttcaaaccatttgaaatgttcatcaagatgtacggacttcctaagagcggtgaaatggatccgaccatttttgtaggtatcatgtacagctttatcttcggcgccatgttcggggatgtcggtcaggggctgctgctctttatcggcggtgcgatcctgtatttcacaaagaaaatgaaccttgccggaatcgtatcacttgccggaatcttctccaccttctttggatttatgtttggaagtgtgtttggatttgaagacattatagaagccagatggatccgaccgatcaaccacatgacaaccttaccgtttatcggaaagctgaataccgtatttatcgtatcgattgcttttggtatgggaatcatcctgatttctatgatcttccatattatcaacggcatccgtgccaaagataccgaagcaacctggtttgatgcaaacggcgtggcagggctggtattctacggggcagcagttatctgcatcgttcttttcatgacaggtcactctctgccggctggaattgttcttgcagtgatgttcggagtaccgcttcttctgatcgcactgaaagagccgctgacgaacaagatcaaaaagaaaaccgaaaaaatggaacagagcaaagcaatgtttgtcacccaggcattttttgaattatttgaaaccctgctcagctatttttcaaatacactttcctttatccgtatcggtgcattcgcagtcagccacgcttccatcatggaagttgtactgatgcttgccggtgccgaaagcgggcatattaactgggtagtgatcgtactcggcaacctgtttgtatgtggattcgaaggactgatcgttggaatacaggttctgagacttgtctattacgaaatgttcagccgcttctacaaaggcagcggtcgcgaatttaaaccttatacaggtactgcaaaaaattagtttttcattttaggaggaaattatcatgactttagcaactaaacttattctcattgccgcactggttttaagcattttcattccattcggatattatctgctcggagaaaaaaataaaggacgttataaatgcgctcttgccttcaatgttctttcttactttggaaccttccttgtagccggaatcatgctctttggaagtgtaccggtacatgcagcagacgccgcagcctcaggcgcaggtctttcaaccggtcttggttacattgcagcagctcttgttaccgggctttcctgcatcggtggtggtattgccgtagcaagtgcagcaagcgcagcccttggagctatcagcgaggattccagcgtccttggtaaatcccttatcttcgtaggtcttgcagaaggtgtatgcctgtacggtcttatcatctccttcatgatcatcagcagactgtaatcatgaagatgtatctgatcagtgacaacgtggatacttataccggaatgcggcttgccggcgtggacggtgtcgtagttcatgaaaagcaggaactgcgtgatgcgctggaaactgccatgaacgacaagtcgatcggtatcgttcttctgacggaacgctttggaagagaatttccggatctcattgatgagatcaagttaaaaagaaagatgcctcttctgatcgaaattccggacagacacggaacaggacgtaaaaaggatttcattacctcatacgtcaacgaagcgattggactgaaactttaactagaaaggcatagaaggtgagacaatgacgcttgaagagaaaatagcgcatttacaggaaacggtcatgactgaagcccgttctgaaggaaatgcgatcattgacaatcacaaaaaagcgcttgaatctttatttgaaaagcataaaaaagaagcgaccgcacagtctgaggtccgcatcaaatccgagaccttaagagccagaaggcaggtaaatcaagctgcggcaaaagccgaaaccgaactgaaacgtgctcttggcaaaacacaaaatgaattaaaagtcaggctgtttgatgaagtaaaggagcttctttctgactttacaaaaacagacgaatatctggactatctctgcagcaaaatccgcgaagccgcacgctttgcagatggcgaggagatgaccatttatatttctccttctgataaggagaaacagacagaactggaaaaacgtaccggcatgacgatcaccatcagtgaatatgattttatgggcggtatgcgtgctgtaatccgaggccgtaatattctgatcgatcacagtttccaggctgcagtcgattacgaatatcatcagttcagttttgcagcaggaggtgcaggaattgaataagacagcaactatttatggaataaacggtccggtcatctatctgaagggtgacaccggattcatgatgtcagaaatggtctatgtgggaaaggaaaagctggttggcgaagtcatttccctggacaaagacatcacgactgttcaggtctatgaagagacttccgggctgaaaccgggagagatcgtagaggcttccggaagcccggtatctgtaactctggcacctggaatcctgaacaatatttttgacggaatcgaacgcccgcttgagcagatcgcaaatatgggcggcggtgcatttatcacccgcggtgtcagcgttgattcgcttgaccgcgacaaattatgggatacccacatcaccgtggccaaaggagattaccttcacggcggagatattatagcggaggttccggagaccagtgcgatcgtacacaaatgcatggttccaccggatgtggagggtgaagtaatctgctgtgcatcggacggagaataccggatcgaagatacacttgtcactctgcggctttccgacggaacagaaaaacagctcaacatgatacagcactggccgattcgtaaggcgcgcccgacaagctaccgtttcccggcaagtgtccctctgatcaccggacagcgtatcctggataccatgttcccgatcgccaagggcggaactgcagcaatcccaggcggattcggtaccggaaaaaccatgactcagcaccagattgccaaatggtctgacgccgatatcatcatctacatcggctgtggcgagcgtggaaatgaaatgacacaggtgctggaagagttttcagagcttgtggatccaaagagcggcaatccgctgatggacagaactactctgatcgccaatacctccaacatgcctgtagctgcccgtgaagcaagtatttacaccggacttacactggctgaatattaccgtgacatgggttatgacgtagcgatcatggctgactctacttcccgctgggcggaagccttacgtgagctttccggccgtctggaagagatgccggcagaagaaggtttcccggcttaccttgcaagccgtctgtccgctttttacgagcgcgcaggcatgatgcataacttaaatggcagtgacggatccgtgaccattatcggcgccgtatcaccgcagggaggcgatttctccgaaccggtcacacagaacaccaaacgtttcgtccgctgcttctggggtctggacaagagccttgcctacgcaagacatttcccggcgatccactggctgaccagctacagcgagtatctgaccgatctcgccgcctggtaccacgacaatgtatcacccaaattcgttgactaccgcaaccgcatcatggcacttctgaatcaggagagcagcctgatggaaatcgtaaagctaatcggaagtgatgtacttccggacgatcagaagctggttctggaaatcgcaagagtcatccgtctcggatttttgcagcagaacgcattccacaaggatgatacctgtgtctctctgcagaagcagtacaaaatgatggaaatcattttatatttatacaaacgctgccgcgaactggtagccatgaatatgccaatgtctgtcctcaaggaggaaaatatttttgaacgtgtcattgctatcaaatacgatgttccgaatgacaatcttcagctccttgaccagtatctggcagacattgatgctttccatgaccgtatcatggaaaagaacgcgtaaggagggaaaataaaatggcaattgaatatttaggcctcagcagcattaacggccctctgatcgcgctggaaggcgttcaggatgctttttatgatgagatcgtagattttgtcgtaaacggcaaagaacacaaaatgggacgtattgtggaggtctacgaggacaaagcaatcatccaggtatttgaaggcacggaaaatatgtcccttaacaatacccacaccagacttaccggacatccgatggagatcggtctgtccgaagaaatgcttggaagaacctttaacggaatcggagaaccgatcgacgaccttggaccgattacggttgaagaggtgcgggatgtcaacggacttccgttaaatccggtcagacgtgaataccctcgtaactatatccgcaccggaatttctgcgattgacggactgaccacactgatccgtggacagaagctgccgatcttttccggcaacggtcttccgcacgaccagcttgccgcacagatcgtaaagcaggcttccctgggcggcagcacaaatgaggatttcgccatcgtattcgccgcaatgggtgtcaagcatgacgtagctgatttcttccgcagaaccttcgaggagagcggtgttgcaaaccatgtggcaatgttcctgaaccttgccaacgatcctgtcgtcgagcgtctgatcaccccgaaagtcgcgctgaccgccgctgaataccttgcatttgagaaaaatatgcacattctggtcattcttaccgatatgacttcctttgccgaagccatgcgtgaggtttcttcttccaaaggagaaatcccaagccgtaaaggatatccgggatatctgtacagtgaacttgccaccttatatgagcgtgcaggaatcgtagaaggagtaaatggttctgtcacacaactcccgatcctgaccatgccaaatgatgacattacccatccgatccctgacctgaccggttatatcaccgaaggacagatcgtacttgaccggaatcttcacggacaggcaatctacccgccgatcagcgttcttccgtccctgtcccgtctgatgaaagacggtatcggaaaaggctataccagggaagaccaccaggatctggcaaaccagcttttctctgcatatgctaaagtaggagaggcccggaatcttgcttccgttatcggagaagacgaactttctccgattgacaagaaatacctggaattcggaaaggcattcgaggagcgttatatcggccagggaccgaatgaaaaccgtaccatcgaagaaaccctggatcttggctgggaactgcttagaatccttccaaaagaagagcttgaccgtgtcgataccaagattcttgacgtatactacaaaggctaaggaggggagtctatggatccacgttcatttcccaccaagggaaatctgatacttgcgaaaaattcactgacacttgccagacagggatatgagctgatggacaagaagcggaacattctgatccgcgagctgatgggcctaatcgacgaagcaaaggatattcaggaagaaatcgataaaaccttcacctatgcctatcagtgccttcagagggcgaatatcgagcacgggatcagtactgtagaagaacttgcctatacagttccgatcgaggattctatccgcatccagacgcgaagcattatgggaacagaaatcccgaaagtgaagtacgaaaaagaaaataccagaccaacctatgcattcagtacttccagagaatccatcgatatcgcccgtgatgcattctgccgtgtaaaggagctgacactcaagctttctgaggtagaaaatgcagcgtacagactggcttcaagtatcaaaaagacacagaaaagggcaaatgccctgaaaaatattacaattccgatgtatgacaatctcgtatatacgattacaaatgcactggaagagaaggaacgagaagaatttacccgactgaaagtgatcaaacggatgaaaaacaaataatatttctgaaaaaatcataaaatatagaaaatatattgacaatacacccgttttgttatataacttatagaacaaataagattacaaatgcaatagattttacaaatcagggggtgagcatatgactttttggaaagtatccgacaccagaatgaactgccttatcacagaagcagagattgccgcacttggctactcactggaagatctgacacaggacagggagcgtaccgaagaatttttgaatcttcttctcaagaaagggaaagaagttcttggacttaacacagacaatggaatccagggattttacggtgcatttcttcctgaccggagcctgatgctatcgatctcctgccaggctgagaattctccggaatccgtccaaaaagatggttctgaaacttccggtatgctgatcgagcctgacagcagtgagaaagagactattcgctggcagattctctttccaagtctggataatgcaatcgacttctgcaagatcctcggatgcggccaggcatcagaaagccgtctgtataaagatgacggtgtctactatctgatggtagacttctcaaatacggaagacggcaataaaaaggctcagcgcatcgtatccgccggtgaattcggtggcatggtcgaaaaagatgcaatttctgaagcttatctgaatgaacacgaaaaatgcctcctgaacaaggatgcgatcgatattttatgcaagatgtagtagaaggggactgaaatagtcccctttttagtacacgaaataaatttttctttatttttccacagatccagtagctttccacaaatgaaataaacgattacttttacacatgcatccgtctgtagaaacagattccaaaaaaagagcaccgtccccgatgctaattcatcaaaaacagtgctgatactgcgccttcagggattcgaaccctggacaaatagattaagagtctactgctctaccaactgagctaaaagcgcatacattattcggttttccgtaacgcaagatttattatataagacagccataaaaaatgcaagcttttttttcataaattttaaaattttttaaaaaatatattttttttctgaaaaagaatgtgccttggcacatataaaaagatcatgtgtaccgtcagaaattcgaacacatgatctttttgtgtaccttttagggttgcttttttcttatcttacataaatttactgatatatccctgtacaaagataaataatacaatcagtggcaggatatagcttacataaaatttcgcccatttcgggaatttcaatccttctccggtatccgcttctttcatgaagttcttccatccccatccataacggcttgtacagaacagaagatagaccagacttccaagtggaagcaggttgttacttaccaggaaatcctccagatccagtactccggaaccttttccgaacggcataaatccactccatacattaaatccgagaacacaaggcatggaaagtaccgccacaaccacgatattgacgattacagcctttttccggctacatccggtcaaatcaatggcaaaggataaaatattctcaaaaacggcgattacggtcgatgccgcagcaaaaatcataaataagaagaataaggctccccagattcttccgcctgccatggaattaaatacattcggaagtgtgataaagatcagactcggaccttctcccggatccaccccatatgcgaagcatgacgggaaaatgatcagacccgcgatcaaagcaacaaaggtatccagaagtgttaccaggactgcttctcctgtaagactgcgggatttgtcgatatagcttccgaaaatagcaattgcgccgattccaaggcttaatgtgaagaaagcctgtcccatagcggcaaaaatcgtgtcaaataagccatattccacgactttgtggaaatccggtgccagatagaagcgaagcccctcagaagccccatcaagcgttacagaacgtgctgcaaggatcaacatcagtgcaagcagaagcagcatcataaccttcgtgatcttttccactccattttgaagccccattccacaaattgcaaaacatccaacaacaacaatgatcataaagaaagtcattgttccaggttttgcaagcatatcggaaaacacacctgcaacagcggcagtatcctttccctcaaattcaccagtcatcatcttgatgaaatactggaccatccatcctgcaattgttgtgtagaacatcatcagcagatagtttccggccatagctccatacttataccaatgccatttcgttccttttggctccagacggtcaaaggaaagtgccgcacttactttactggctcttccgacagaaaattccattaccatgatcggaagtccaaggatcagtaaaaatgcaaggtaaataagaacaaacgctgctccaccatattttcctacaatataaggaaaacgccagacattaccaagaccgatcgcacatcctgcagaaataaggatgaatccgagtcttgaagaaaacttttctcgttgcataaaaaatcctctcattctattaaattgtggataacttgtcgaaatgatacttatccccatttttcgacaagtatgtggataacttttttcagaatatccacagaggaattatactgaattactgggaaattgtccatgattgtttatattttcattggcgaagccacctgataattttaattttcccctttttagtacacaaaatcgtcagatgtgtaccttttggggtgaaaatttgcatgtatatatatattaaagataacaacagcttattaaaattcctttgtttatattaggagggctgaaaaagcccgtggttgacgtatttcggggcatattttgtgtacggaaacgggggaggttgtttacttcaaagggcaaagaggtgtacatatatgggggttgttgtttactttgcagggttacgcagtgtacttgaagggttggcgattttaccttttctgtacacaagtgtcgaaaaaatttaaaaaaaggctttacaagaggggggttcttgtatataatcaacctagacgtaccgttttggtacacattttttatcaaaaaaggtaccttaatggtacacgaaaagaacaatacacaccttaaacgtacacaaaacgtaaaaaaagacagaaaccccattttatggggtactttttaggggagggtgttcctttttggtacacaaatccccaatataaaggggttggttaccccgaatggtacacaataagggattatatggggtgtagaggggattttaatacacctcaaaagtacacaataatacagaagaaaacaattaaggggtatgagcgatgaaggaaacacagaaaaaaccaaaagagaaacaactgctggaccgtgatacggtctcccggtccaatgtgctgatcgaaagtaaatccagtacatcattatttgaaagaaagcttcttaatattgcaatcgcaaaagcatatatagaagacggtgagctgatcgcaaaggtttccaccaaggatgttaagaattatcttcatataacaggaaactccatctattcccgtctgaaagaagtatcaaaagagacattgggacatgtagtaagtattgaggacgacgaaaaagagaacttcatcatgttcaatgtagtgaataaatgtgaatatagagatggtgtgtttacgaccagatttactaaagagatgaaacctcatatctataacctgaaaaaagactatacccgtatgagtcttgatgtattgtgctcttttaaatccctgtttacaacccgtgtttacgaaatcctgagaacccagtattatcgttttgacagggaacagtgtgaccagctgatcgtaccgagaccgccgaagaatccatacacgatcgcagagcttaaatttacactaaatgtagttgatgcaaatgcatctaaagcagtaaaacgtcttgttgagcagggacgttttgaagaagcgcttgcagagattaaggatgcaccgtttgaggactggcgtaatttccgtagaaaagtacttgaagttgcgaaaaaagagctggaagaatccgagtattccgagatctgctttgattatgagccggttaagagcgggaagggcggaaaggttacaggaatccgtttctttgtgaagaagaatccgaagtgtatccatcattcagatcttcagcgtatgccatccggagaagaagagggcgaagagattgcgccaaatgtactggctgcaaagaaaactccggttaatgaaaaactgattttagaagttgccgatatttttggaaatgaaccgatcacgatccaggagatcaaggtgctgcttcaggtatccgataaccagccggatgtgatccggaaagctttcaagctgtcacaggagcaggcatacatcaataatctggtcggatggctcagaaaatgtatcgaagaaaagtggtatgagaacgaaaaagtatccaagttcaaaggaaagacgctggaagaagcgcagatgacgctggatctttatcaggaatacatagaagagcgcgagaaagtgaaaaaagagtagggtattttctgcgaaaagtagaattattacctaaatggtacacaagttaagtggataaatgtgtccccgggatgttatttgcaaagagacaggtagcatcccggggattttgtgtcttattttatgatggaaaattaaattagatgttgggatccaaaggtattttgaccctggtatcttaaattatggaggaacggaagaaaattatggaaataagaagattactggattttttaaagacagcggaacaactgaaatgtaacaccagacattcgtatacttcaagtggcaggttggagagtgtggcagagcacagttggcggctggcgttgatggcaatgctggttggagatgaatttccggagctggatatggataaggtgataaaaatgtgcctgatccatgacatgggtgaggcaatcaccggagatattccggcatttgaaaagacggataaagaccgaaaggttgagaataaaaaggtggagcagctgatggatacgctttcggaaccggtccgtgcagaatggaaggcattgtttgaagagatggaagcgatggagacacaggaggcgaggctttataaatcactggataagctggaggcgctgatccagcataatgaggcggatatctcgacatggattccgttggagtatgatcttcagatgacgtatgggaatgaagaatgtaagtttacggaatatatccaaaggcttcgggatgaagtgaggaaagattccaagcggaagattgaagaaagcaaacagaaagactaataaaaaagaacgtaacagattatatcaggaaagataaaatttgttacgttcttttcagtttctgagaagttaaagagattacatgcttaagatgcacattttttcacagaaacttagattttatgaaataaaaaattttcataatagttgcattgaaaatgtaatactgcatattcatgctttatccgtaaattttacgggacagctggtttgcagtatttttcatgtattccagtaaatccgtattctgtaatttatcggtaattcgggaagttgcaccagatacactgattgcaaaacctggttttccaggtgcctgaaataccggaactgaaacacaggtaagaccgatttcaatctcatcgttatccattgcataaccattgtggcggatttttgccagttctttatagagcggctcgcgctctgtaagtgtgttgtaagtacgcgctgcaagtggaaactgaagaatccgatcacattcttcttctgatttgtaggcaagaagacatttacctacacctgtacagtgcatataatttttgacgcccatttttgtattgatgataatagatgagtcggattcaactttgtccagataaatcacacttgcatttcccgcatcaatcgcactgtgaactgtttcctgataacggctggcaatactttcgagataaggatgagtgattcgtacaataacattattcatacgaagagctgtggaaagtgaaagaatcttaggaccaagacaatatttctgattctcgttgttctgcataagatatcctaattccgtaagactgtttacgataccaaaagccgtgcttttgtttaatcctgttttttctacaatctcctttaatcccaattccgtaacttggttttgaaacagttctaaaatcatggcagcgcgttctaatgattgaatcatttttgttgttgccataaaattttcctctttctttttcttaaaccgtatcacgattagaaaaaaatatcaatgtttttccaaaaaatattaaaaatatttttgtgaaatatattcaaaaaaacaagttcactttagtaaaaaattaacattgacgacaaataaaaaacgcgatattatttaaaacgtagaacagagttctacaatgcagaacacaacgaagagcgaactgcgcaggctctttggtgttatagattcttaaagtatgaaatagaagctgccggtggcaggttctatgtattcttaaatgaacagatcatttaagagaaaatggacaagaaactcatatatttgataagcaaacaggaggacaaaaaatggaattcagaagtaatgaaatcatgcacggagaagatgctcctttttatcggtcactttttaaatcaatgggatattcagatcacgaactggatcaccgtccgctgatcggaatcgcaaatacatggaatacatgtgttccgggacattttaatttgaatcaggttaatgaatttgtaaaaaaaggtatttacagtgcaggcggaacagcagttgaatttggcacgatcggatgttgtgatggtgttgcacagggacatatcggaatgaactatattttaccatccagagagatcatctgtaactcagttgaggtcatggtacaggcacacagacttgatggtatcgtacttttagcttcctgtgacaagatcgttccgggtatgctgatggcagctgcaagacttgatattcctgcaattgtatgtgtaggtggaccaatgcttggtggaatcgaatttgacggacgtaaatcagacttgacttccattgatgaagcaaagggaatgtgtgcagctggaaaaattgcagagtgtgaatataaagcactggaaaatacagcatgtccaagctgtggatcatgctcattccttggaacagcaaactctatgtgctgcgtatccgaagcacttggaatgagtcttccgggaagcgcactgatccctgcaccgtatggcgaacgtctgagatcttcatttgcagcaggtgaggcaattgtaaatctggttatgaaaggtattacagcaagacaggttatcacaaaagaatcaatccgcaatgcaatcaaagttacaatggcgatctgcggatcaacaaatgcggttcttcatctttcagcaattgcaaatgaagcagaactggatatgaatgttgtggaagaattccgtgccctcaacaagacaacacctcagattgcaaaggtcaatccggcagcaaaatgggatatggaagcattctacagagcaggaggaattccacgggtaatggatcatctgggagaacttcttgatacagagtccatgacctgtacaggaaaaacaatttcagagaacctgaaagagtatacatacagctatccggaaaatccggagatcatcaaaacagtagaagaaccattctctacaacaggtggcgttgccgtactggatggaaaccttgcaccgcacacagcaatttcaaaaccgggagcaatcgatccgtcattacaccgttttacaggaaaagcaaaatgctataactcagaagaagaagcagaagaggcgattcttggaggaaagattgaaaaaggcgatgttgttgttattcgttatgaaggaccaaagggcggacctggaatgcgtgaaatgttcaaggctatgaagtacatgtatggaatgggacttgcaaaatcagcagctctgatcacagacggacgtttctccggtacaaataatggatgctttgtcggacatatttcaccggaagcagcagagggcggacctcttgcaatcgtagaagacggtgatgaaatcagcattgacgtaatcgatggaaaactggagcttcatgtttcggatgaagaaattgagagaagaaagaaagcctgggtaagaccggaaaaaccaattccaaacggttatctcagattatattcaaaggttgcatcttcagcagacaaaggcgcaattatcgagtgttaatttgactggggaagccagggaaaagcttccccgcataaagagaaatggatggacgagacaggaaaggaatatagtgatatggcaaaattttatacggcagtggtaaccgtctttcatgaagatggaacactggattatgagggaaacaaagcagtatatgaacatttgatccaggcaggaagtgatggaatcgttctgatgggaagtaccggtgagttctgcagcatgacaatggatatggcaaaagagcttacaaatctggcacttgataccatcaaaggacgtatggatgttattgtcggtgcgtcaagaatgattccggaggagagtgtcgagcttgcaaattatgcaatggaaaaaggtgcagatgcaattattatgatcacaccatattactttaagctttcagatgcaagtatcgaagcattttatgaccagacagttccgaaaatcaatggaccggtatatttatataacttcccgggatgtacagcacatgaattatcaccggagcttgtacttaaacttcgtcgtaaatatgacaatatcaaaggatgcaaggatacagtaaagaactttgaacatacccgtaagttatgtaatacattgcttccggaatttccggatttcgagatttacagcggatttgatgaattttttgttcataatgtattatctggtggatgcggatgcattggcggattaacaaatatgtgtccggagctttttgtggaatggacaaaggctctgaatgcaaaacagtgggataaggttgccgagatccagaaaaaagtaaatcagatgatggaaatgtttgatatttcggcaccatttcttaccgcagtcaagagaacgatgcagatcagaggaattatttcggaggaatacggaaaagcaccgcttgtaattgcatctgaaaaggaagatgagaaaattagacagcttttaaaagaacttgatatctaaatacggagggaaagaaaatgacaataacaactttgggggctattttaggattagttgttgcgattatccttattatttacaaagtaccaccggtatatggaatgatggtgggtgctcttgtcggaggtctggtaggtggagcatcgcttgctgataccgtatcttatatggtaagtggagctagtggtatggcatcaggaattatgcgaattatcgcagccggtatgcttgcaggctttttgatcaaatcaggatcagcagaatcaattgcacatacgattgttaaaaagatgggcgaaaaatatgcacttcttgcagttgtacttgcagcctgggttctgcaggcagttggaacttttggagatgtaattgtagtaattgttgcacctattgcactggatattgcggtacgtacaaaatattcgagagcagcagcttccattgcactgatcggtggtatccatgccggaaatattgtgtcgccgaatgcaaatacaattgcactggcagagaactttaatattccgcttacaacagtaatgatcggtggattgatcccgtcagttgcagggttggtatttagttatattttcatgaaagttcttagaaataaaggagaaatgattgatccgtcgacgattgaacattctgaaaatacagaaaatcttccttcttttggacgtgcgatcattggacctatctgtacaattgtattattgatgcttcgtgcgttggttggaattaccattgatccaatcattgcacttccggttggtggtattgttggaacgattgcaaccggtcaggcaaaaaagatgatggattttgcaacaactggtatttcacgtatgagcagtattgtattacttcttcttggaacaggtacgatttcaggtattattgcgaattctgcattaaagacaacacttgaaaatctggtgcaggcatctggaatgccgggatatttgttagcacctatttccggtatcgttatgggtggtgcaaccgcttcatgtatcgctggtgcgactgtagcatctcaggtatttggatctacgatcgtttcatttggtgtgacaggagttcaggctgcagttatgatccatgctggatgttgtgtattcgactgtctgcctcatggaagcttcttccatatcagtgcaggaacattgagaatgtctattaaagaaagactgaaagtgattccgtatgaatctttaatcggatttggaatgacagttgtggcgacaattgtatatggtgtaattggatttacattttaaggtatttgagccggggcgaatgtcccggcttattttctatatatgataagtaaaagtttagttataaatcggggtaacaggattcgaacctgcgacctcgcggcccccagccgtgcgctctgaccaagctgagccataccccgaagtgttatttcattatagtataaattgttttaaatctcaatcattcttttgatgtgagaaaatgctgttgacaggtttctggaaagagttcaaaataacgatatgcaaatatgaatgagtaggatgaggaacgattatggaaaatttaattttcagtttgaatgcgacgattccgatatttttaatgatgttactcggaatgttattcagaaaactggggtggatggatgaagtctttgcagcaaagatgaacaagtttgtatttctggttccgcttccggtgttgctgtttgaacagctggcgaccgtggatttttcggaagtatgggatattaagtttattcttttttgttttgtggtgacggcgatcagtattacgatatcaactttgatttcactgctgtggaaagaccggagcattaaaggcgaatttatacaggcgacttaccggagcagtgcggcgcttcttggaattgcttttatccagaatatttacggaactgcgggaatggcaccgcttatgattattggaagtgttccgctttataatattatggcggttgtggtgctttcattgtttaaaccggggaataattcttttgataaggcgctggtcaagaaaacgctgaaggggattgcaacgaatccgatcattattggaattgtggcgggatttgtctggtctgcacttaagctttcgatgccgacaattttacataaggttgtatccaatgtcgggacgactgcaacgccgatgggtctgatgtcgatgggagcgacatttgagttgaggaaagcgacatcgaaaatgaagccgacaattgtggcagtgtttatgaagctggttggattttgtgcggtttttttgccggtagcagcagttcttggatttagaaatgaagagttgattgcgattctggtaatgcttggatctgctacgacggtcagcagttttgttatggcaaggaatatgggacatgaggggacgcttagttccggggtgattatgatgacgacgttgttgagtgcgtttacgcttacgatgtggctggatgtgctgagatcgtttgggttggtgtaagaagaataaaaatagaagcagccagttaaaatgggaattgtggtagcacaccattgactagttgcttctattttttaaagattaaataagtcgctgtgactgccggttcgaaattgagtggtatttttgatttcatattttgtcatgaatcaagatctgcaaaaagttcattaacatcatggtatcctttgatgttaggatcttttgcaatcctttctgcctcaagcatagcagagacggtttctttacttggagttccttctgtaattttgaaaggaattcctctttcgcgaagagactggcggacaaaaatattgaaagctgtgctgagattcataccgagttcttcgtaaagagcttcggctgcagctttgagatcgctgtccatacgaatgctgatattacttgttgttgattttgccatagtaatcacctctttttatgatatagatagccatgagcaaaactccacacattcagtatttatgcgggtttgcgaggcatggcaacctcttttatcactccaaatttatagtaacaatcaactccaaatggtataattaagttgtcaaaatcaattcaccgaaaggagctgattgttatctatcgtcaagaaattttgaaagacatccgtcttttcacttcacaaccagttgcaaagttttatgattctctttttctgaatcttgatttatcctttgttccggaattccccaaaacaggaagaaaagggttttcaaaccacgctatgatttgttcctttattgtcatgaaatgcgaaggtttctccatgatttccgatcttgtcgattatcttcacaataatcttctgattgcgcatttttgtggctttgatatttctcgtccacttccttcttattggacttttgatcgcttcttgaaaaattttgataacaaagttctctctaaaatcatgaaaactcaggtgctattcctttctaaagaaggtattgtagacacttcttttattggcttagattcaactcctgtctctgcaaatacttcacagaataatccgaaatcttttctctcaaataagtttaagcccggaaatcaaccaagggcggattcagattgtagactcggcgtccacactgcatccaatcaaacgaatgagaaaaaatatgaattttattggggctataaaaaccatgtccttgtagactgtatttcaggtcttcctatttatgaaatgaccacaaccgcggaagttcatgatgctaccgtcgctttagatatccttgctgctacccattcctttcaaccaataacggactgcatattccttgccgacaaaggttacgatgtcaaaaatatctacaatcaggttaaggaactttacaatggagaatgtatcattccattaaacaaacgtaataccaaaaatccgaaacttcttcctcaagggaatcccatttgcgaagcagggcttgccatgtggaaggatggtaagttttccgattgtggtcgtacccgtcaaaagttttgttgtcctctaaaatcaagtaaagataccctttgcccatgccaccacaaaaatttctataatggtaaaaagcatcgtggctgtacgagatatctcaccattcctgatgatttaagactttccattgatagggacagcaaatattttaaaagtaattattcactccgcacagaatgtgaacgctataattcgcgttttaaaaatactggtcaagagcggatgtgggtaagaaataaagcatctgttacaaacttaaacacacttgcccatatcagtttactagcagttgccgttgccgtaatcactagccattctggtcagtcttatcgcaaactaaaaacaataaaacgaattgcttgattaaaaaattctcatagtcttatgatttcgtaagttttggacttacgttagctttgctatgccataaaatcgcaacctcaaactttatgggagctaactgccaagttctacttttggatcaatatgttttgctcatctctagatatagatattatatggcaaatgcacgaaaatatcaatatattgcacgaaaaaatacattatatatgagctgctgttataggggcgcgaaggcgctggcgctgttcgcttgggaggatggtgccaggggcggggaaggcgctggcgctgttccccttggatggatgtgtgttgtaggtaagaggagtttgtgggtcgaatgatttaggtaaagagcagtgcaccacagctcgtgaacctggcggttcattcgctgtgcgagctatcgctctatcaaaataaaataacacccaaattttcatgcgagcatgaaatttgggtgtttttttattttggcactgctctatctgaggacaaagtactgttcataccacagtaagaatgaatatactgtataaatctttctatgataatttccgactttatttttatgatcttccagccatttcagcagtaattcctgattgaagaattcggatacgaagtctttctggaacatttcttttactttattatagtatttatcttcccggagccatactctgaatggtacgaggaatccgagttttttacgttttgcccagtccattgggatgtgggagagggcggaggtacggaatgcttttttggtttccatgccgtcgatgcagtatttgctgtcgatgctgcgggcgagttcccagacttttttgtcgaggtatggtacacgcagttcgagggagtgtgccattgtcatcttatctgctttgagcaggatgtcgtgtggcagccacagatgcatatcgaggaagagctttttatgaaggtcgtcctgatcttttacctggtcgaagtacggtttggttacgtcctggtagcgcatcttgctcttgtatgcaggagcgagtacttcatctgcttcttcgttgtccatgatgaatgcctgtccgatgtaggaatcttctacggaagttgcatttctcttgaggaagttaagtcctctcttgtctggctggtgttttgcccagtctccgagttttttacggatagatgccggtacgatcttgcggtacatatcaccggatttgcttggaatatatgtctcgtatccaccgaacatctcatctgcaccttctccacttaagactacttttacatctttggctgcgagctgtgacagatagtacagcggtacagcggaaaggttggcatgtggttcatctgaatgatactgaacttccggcagagcatcgaagaattcatcggaagagatttctttttttgcattgctcatatgaaggatatcgcacagatccttggagaaggttgtctcatcgaatccgccgacttcaaatcctacggaataggtcttcatcggttttacagtagatgcgatgtagcttgaatcaacaccacctgaaaggaaggatcctacttctacatcagcaatctgatggtaatcaacagaatcctgaattgtctcaccgatgagttttactgtctcgtcaaagctgcggtctttctttgcataagtcggatcgaagtattttgttttcttaagttcttttccatcataagtgaagtatgttcccggttccagtttgaatacacctttgaacatggtctcaaggagtggggtgtactggaagatcaggtacatcttgagggcatctttgttgacctctttatggaaatgtgggtgagccaggaaggacttgatctcagaaccaaataaaaggcttccattcatctgtgcatagtagaatggtttgattccgaagtagtctcttgctccgaataagttgtgagtttctttatcataaattacaaatgcgaacattccgcggagcatagaagcaattttttcgccataggtcttgtatccctgaagaataacttctgtatcggagtttgtccggaactgacatccgtgtttctcaatcagttctttacggatttcctgatagttgtaaatctctccgttgaaaataatgacatgtttgccatctgcactgtgaatcggctgagatccgccttcaaggtcgatgatactcagacggcggaagccaagggctacatagtcatcaacaaagcttcccttgctgtcaggtccgcggtgggcaatgcgttcacccatctggtcgatgacttcttctctattaaaatcgccggcgccataatagcctgcaaatccacacataaattgcacatcctttctgaattgatacatattaaaaatattatagtaacttaattttgcctgtagatttatttattataccatagtctatataagattaacaagggataaaaaaccggaaaggaatatccaataaaatcagtaggatattccttgcatattttttacaggtgttatatagtgaaaaatgcggataaatgcgtaaaagccggcaaagaaaaggggaatccggggaatggaaaaggtaaaaactttcctggcagatatatctgatctgcttaatgagaaaaattatcaaaaaatttataaaaaagttccggcgttccgacaggaaaaagcagaccggctgaagcacagggaggatcaggctcaaagcgtgggtgcatggtatctttggatgaagatacaggagagacacaagataccgcaagatgcagggcagtcttttaatttatcacattctgggaaatatgttctgtgcagcgcaggcgtatccggagagcgggtaggctgtgacatcgaatgtatgcgaaaatatcatgaaaggctggcagaaaaatatttttgttcttctgaatatgagaggatccggaatgcagatgaagcagagcagacggaaatgttctaccgctactgggttttaaaagaaagctttttaaaagcgacgcgcaaaggccttgtgatgggattgaataccagcgagattcggattccgaagcagggagatccgtttttgttaaggcagccggaagagatccgggaaacttattatttaaaagaatatcagacagatggagcaaggattgcggtctgctcaacgaatccgaattttgacgaaaatattttggatatgacagatatttacaaaagagaaatgattgtggaacttaaagattgaaaataagccaatgaaacaagaagtggattggttaagagtttacaggtattttatgagagaagaaggagaagaagatgcttacacaattttcgagaacagaactgcttcttggcaaagaggcgatggataaactgaagaattcaagagttgccgtatttggaatcggcggagtcggcggttatgtatgtgaggcactggtacgaagcggagtcggtgcatttgacctgatcgatgatgataaggtatgtctgaccaacttaaaccgtcagatcattgcaaccagaaagacggtagggaaatacaaaacagatgttatgaaggagagaatgctggagatcaatccggacgtcgatgtgcggattcacaaatgcttcttccttccggaaaatgcagatgaatttccgtttgatgagtatgattatgtagttgatgcagttgatactgtgactgcaaagattgagcttgtcatgaaatcgcaggcaatgaatgtgccgatcatcagcagtatgggagccggaaacaagctggatgcaagtgcatttaaagtggctgatatctataagacacagatgtgtccgcttgcaaaagttatgcgccgggagttaaagaagcgtcatgttaagaagctgaaagttgtttattcagaagagaaaccgaccagaccgatcgaggatatggcgatcagctgcagaaaccactgtatctgtccgccaggagcaaagcataaatgtacggagagaagagatattccgggaagtgtggcatttgtaccatctgtagtcggactgattatcgcaggggaagtagtgaaggatctctgtgcaaaataaaaataaaatcgcgggcgcccctgcggggcgcatatcaaagccaggcatttgctgtcagaacttgcagcaaatgcctggcttttttgtttcattttttttcacagattttccggaaaatcttatacaatctgtatcggagatcaggaaacagaggtaactctggagagtaattatacagagctttaaacttaaaaaattctaaacttgtcggaaaagactgttttctcatgaagaaatatgttaaagtaaggctgaaatatgcgtaaaaaggaacaaacattaacgagatgtcgtttaaggaaggaagaaccatagacatatgatgagagaagacaggaaaagagcggagcagcgccagaaaaaaatagcgaggcgcaagcgggaagtacaaaggatgaaaagaaagctatataaagcaggcattcttgcagcagcaggaattatcgtgttggctgtgatcctgatgctttgtggaagtggaaatgcaaagaaatctgcaaaaaagacatcctctgccaagacaaagacagagacagaaacaaagacaccagaagagatagaagctgagaaagtccaggaggtgctggattctgaccagtataaagaccagctgggcgaattatataagaaaaacccggagacgaaggaaatcattctgaacagagaaaagtattccgatgatctgctgacatggctgtttgatcatcaggaagcactgcagtgggtgattgattatccggaacagtcagcacgatcagaggaagaactcagtgcgcagggacttcaggcggtagatttgaaagattacagaatccagaaccatattccggtatatttccagtggagcgaagtatggggatatgcatcttatggttccgagaatatcggaatgggtggatgcggaccgaccagcctttccatggtggcgacaggacttacaggcaatacttcatttacaccgaagtatgtggcagatatgagtgtcaatatgggatattatgtagatgaagtcggaacagactggacgcttatgactgcaggagcttcagaacttggaataaactctgcacagcttacaaactggtcagaagacactctcaaatccgagctttcggcaggacatccgatcatctgcagtatgggaccgggtgattttacaaaccagggccattttatcgtcctttccgggctgacagaggagggcaaggtactgatcaatgatccgaacagtaagatcaacagccgtaagaaatgggatctgaatacaattataaatcagatgaatgcagcgtggtcattctgggtataaaaatttggaaaaagtgcaggagaattggataaattcccttgcgcttttcttttatttatgatataaatagatattgtcgagagacaaaatgggtggattcccgagtggccaaaggggacagactgtaaatctgctgcaatttgcttcggtggttcgaatccacctccgcccattgatgcgaggttgaaaagacagtgcagagcgcgtatgcttttcgcaaaaaccgtttgagcatctcttgccgcagtggcggaactggcagacgcccgggacttaaaatcccgtgggtagtgatacccgtaccggttcgattccggtctgcggcagtgtttgaaaagcaggagaaacgttgaatttacagcatttctcctgctttttgtttaaccgggattctgttaaatacgcaatttgccggcgtagaggcagaaaagtagatacagaaaggaatggaggcataaaaatgggagcatatcaactgaaaaatgaagaacttacactgactgttatttcagcaggcgcagaaatgaaatcgctaaaagacaataagacagagcaggaatatctgtggcaggcagatccaaagttctggggaagaacatcaccggttcttttcccgatcgtaggaaattatgtgcagaagcagtcggtatacgaaggaaagacatatacgctgtcgcagcatggttttgcaagagacatggaatttgatctggagagccagacagaagaagagatttggtttgtactgaaagatacagaaagtactttggaaaaatatccatttcattttattctgaaagtaggatacagactctccggacgtcaggtggaagtaatgtggaaagtagaaaatccaaatgataagaagatgtatttttcaatcggagggcatccggcatttaactgtcctttgaaagaaggagaaaagcaggaggattgtcagttggtatttgatacagaaggaccgctcacgagcagcatcctgaatgaagaaggtgcactttgtccacggacaaaaatattaaatcttttcggaaaatgtctgaagcttgaggaacatttatttgatgaggatgcacttattattgaaaatcatcaggcacagaggatcggtcttgcggatgcagatggaaaggtttatctggaagtagaatttgatgcaccgctttttggaatctggtctccggcaaaaaaacacgcacctttcgtatgcattgagccatggtatggaagaagtgacagagaagattttgaccatattctggaaaacagggagtgggggaatgaactggaaccgggcgatatttttgaaaaggattataagattctggtaaaatagcgcagagggttgcgtttcatggctcagactgatacaatgaaaaaaatacatggaatattaaaggaagaggagaacgtaagatgaactttttggaagaacgtattgtcaaagatggaatcgtgaaagagggaaatgttcttaaggtggacagttttctgaatcatcagatggatattgaattatttgaccagatcggagcggaattcaagaagagatttgcagataagaatatcaacaagatcctgacaatcgaagcttctggtatcgggattgcctgtattgtagccaagcattttcatgtgccggttgtatttgcaaaaaagacacagagcatcaatctggaaggggagatgtatgtagcagaagtcgaatcatttacccacaaatgcaagaaccaggtaattgtagcaaagaaatttctttcagaggaagatcatgtgctcattattgatgatttccttgcgaatggatgtgcgctgcaggggctgattcagctggttacagaggcaggtgcaactgtagagggaattggaattgtgatcgaaaaaggattccagtccggcggaagaatcatccgcaaccttggatatccgctggaatcacttgcgattgtagaagctatggacagtgagacgggtgagatcactttcagagagcagtaaaaagtgcaaaaagacgcatatgcctgaacaaaaattttgtcgggaatatgcgtcttttgcgtatatgatgagctaagtgcagatttgtattttcacagggatctgcactttttgatatacaaaaagagagtgatatttgttttagctggcccacgagcggttatagaaaaacatggaaagtgaagagccaaagataacaatatatccaatcacgctgagcaggtttagtcgttttgctccatccattcatttaaaagcctgcaatagcggtcggtatcttcaacgaagcatacatgacggcagtcatcaaaaagttcccagcgtgaattcgggatactgtcatacatggtctttgcaaccagtggagtgcacagatcgttggttccgttgatgataagtgccggttctttgatatttttcagtttgtcacggtactcatagttgctgagatttccgattggcgtgtattcatttggtccccacgcggtgatataagagtctgttccaattttttttggacggcgcaggcattcaggatcggtgtcttttggtacgccggcggcatgaagaagcataaagcgttcattggctgcgagatatgccggatcgtcaaaattgccggttgcttcagctttggcaatggcgtcctgatcttcctgggacatgaatttgatcatccggtgttgttcctgggcccacaatttggaagatgggtgggtgctggaaagaataacggatttgatcccttctggtttgtgatcgcataagtattcgattgagagcattccgccccaggattgcccgagaagatgaagttcattaagtccgagatattttctgagttcgatcagttcattcatccatgttttagaacaccagagttctgaatgtccttctacataagaattaccgcagccgagctggtcgtaggaaataattgcacgaccttcatcagcaagccggtcaagtacttcaaagtagttatgtgtagaaccaggtcctccgtgaagcagaatgagtggttttttattgccggagcattcgcctgcaatacggtagtaggttttgtatccaagataaggcatgtagccttctgtaattttcatatttaatccctcctatcagtatactgagtctcttcattataacatcagaatgaagtaagggaaagaaaaagtggaaaaataaaaaaataaaaaaaacaaaaaaattgttgacaaacagttgaatgatgaatataataataagagtcacgcgggtgtagttcaatggtagaacaccagccttccaagctggatacgtgggttcgattcccatcacccgcttttgttatgttttaaatcaggagcccggtcgccaaagtggtgaccgggctcctgatttatagagaaaaatttagtcatttttgactggtacattaaaatgtcggctcgattataagggtgaacatttcggtcaccccttgcgtcctgctgccagcagacaaggaagctgttgtatcatattatttctgagacctaaaatgaattttggacaaattttggacaaatcttgatttttcatccgtcccatgctatactaacacccgttacaaaaccccgaaaaacaaggtcgtacaaggggttccgccgatttccggcgtaaggtcatatacttacagtatgtgccttccgcggcattcgtcagatgtccatgcaagcatggccgccagactcattgctgcgcgaaaatgaatcgagtgttcgtgaccttccactcgtaaaacaaaactagaggagagaatttcatatgaagaacaagaatgtagcatttatgactcaggcagcgatgatcgctgcaatctacgtggtgcttacttatgtatttgcaccattttcattcggagaagtacagatacgtattgcagaagcacttacgatccttccggtatttacaccggcagcgattcctggactttttgttggatgtattgttggaaacattctcggaggagcaatcctgccggatatcattttcggaagcattgcaactttgatcggagcattttttacttatcagcttcgtaacaaaaaccgtttccttgcaccgttaccaccgattattgctaacacagtaatcgttccgtttgtacttcgttacggatatggagtagcacttccgattccgtttatgatgttgacagttggtgtcggagaagttgtcggatgtggtgtgcttggattagtcctttatactgcattgaatcgttataaaaatgtaatttttaaaacagcataagaagatgtaaaaagcggacagactgaaaagctattcagcctgtccgttttttatactattgttgtgtatacaatcgtagaattttacaaatttgagtggagatatatttatggaaaagtggataagaatcttctataatataaaaagagaaactgtaaccagatgaaagtttgacagtaagtgaaaaaaggagaaatatgaaatatacagttgttgttgctgatgatgaggaggaaatccgaagaagtcttgttcgcagggtaaagtgggaagagattggttttgaagtggtcggggaagctgaaaatggtgcagacgcgctggaactggttgaaaagctggaaccagatctgctccttaccgatatcaagatgccatttttatcggggattgagctggcacgggcggtcagggaagttcgcccgatggtacagatcgcatttttaagtggatttgatgattttacctatgcgcagcaggcaattcaatataatattgtaagctatatgctgaagccgatttcagcaaaagagatcgaggcggaattgataaagattaaaaaagccatggatcagcgagtggaagaatttacaaaagaaagaaaagagaagctggacatccgcaagacgcaattccttattccgcttttgcttgacagctttcagaatgaacgggtgtccgaagaggcacttcttgagcgggcagaggaatgtgagctgatccgtaatccaaagccggataatatgcagtacgtggtgcttgtaaccggaatccgtgatgcaaatggaaaggatcagacaagctatagcagtgtaaatgcagttgatatgatcttgaaaaaatatgttcattatgtaagctgccatctggaaggaagagtggtatcgctgatcgcgacgactccgggaggtatgggtaagtatttacatattattgtagaagaaattgttcagagtgtggagcgtattatgggatattgctgtcaggtcggggtaagcaggagtgtgaatactcttggaaaatgcagagagagctatctggaggcaatgaatgcgctcagttattccagaaaggataaaagcagtgtctatttcatttccgatgcagagcacggatcgggattggaacagggagaaatacaggaaattacagcaacgatggagaattttttacgtggtggaatggcagaggatctggagatttatctggatgatctggaaaagaaactgcgaaatggaggcaagaatacactggtacttagtacgatacttttgaccgagatcggggcggcagtatataaggttatttatatggcaatcggggaatgtggtgtagaagttcttcagaaaaaatattccatgcagcagatgcgtgaaatggaacgtatggcagagaattttcagatcataaaaatgctgtgtatggaggctaaaaaaatgcttatggatcagagaaagaagagcagcgaggtgatctgcgagcaggcagtgcagatcatacaggaccgctatgcccaacaggatctgtctgttatgatcatcagtgaagagatcggggtgtcgccgaattatctcagcagtctgataaaaaagacgacaggcagttcaatggttgagatcctgacgaaaaaacgaattgaaaaggcaatggagcttctgcagtgtaccggtatgaagatcggtgagattacagagctgtgtggttataaggatcagtattatttcagccactgcttcaaaaagctgactggagtatcaccgaacaaatacaggagggaacatgaacaggcgtaaaaaagaagcagatcagcacaagggatggaatatatctatttccggtgtgtttattgcaatggtaatgggaatcgtcctgatttcggtagtggctgcaacgcttatttttgttcagatttaccggaatgcaatggagcaaagtgcagtgacaagcagttcccagagctgtgaacaggtacagaatacggttgagaattatacacaggatatgcggatcatactggaagggatcgtggcgagaatgcgtcatgagaataatcattctgaggaatatatccagaatctggtaaatatccgttccgatgtagtagcggtaacaatctgtggtgaagatggggagcttctgcgttactggaacagagggcagaagctgaaagagaattatcgcattgttcagagtatcgaaatggaagatgacgatggcaggctgcgtataaccaaaccatatgtggaatctttgtttgagggatattatccatgggttgtaaccgtttaccagaagattcagaaagaagacggaaccagtatacaggtaaatattgacatccgtttttctgacattgccaattatgttgatgatgtagggatcgggcagcacggctatgcctatattgcggacaaaaaaggcaatctgatctatcatccacagcagcagctcatttattccgggttaaaagaagagaagggaatggatttaaaagaagggacacatattcaggaacaggcgatctatactgtgaaaaatctggagaactgtgactggaaaattgtaggtgtctgctatgtagatgaaatgattacggagaaggtaagcagtgcggtatccagacttctgatcgtcctgtgtctggttatgggagcagtctttcttctcggatgggcattttcagaactgttctcagcaccggtaaggcagcttgctgatgacatgcaccggtttgaaaaaaatgctgaaaattttgtatttgagccgatggcgggaactacagagatcacgactttatccaactcgtttgaacacatggttgtgaagatccagaagctgatggagcaggtcagacaggaagaaatcacactgcggaaaacagagctgaaagcgcttcaggcgcagatcaatccacatttcctgtataatacactggatgcgattgcatggatgtgtgaagacgggaaaaatgaagatgcagaagagatggttacggcacttgcaaggctgttccgtatcagtatcagtaaagggcatgagctgattccgatcgaaaaagaagtggaacatgcaaagagttatctgaagattgaaaattatcggtataagaacaaatttacctattcatttgaggtggaagagtcgtgtctttcgtatctttgtaacaaaattactttgcagccaattatcgagaatgcaatttatcatggtgtaaagcagatgatcgatgagggtgagatctggattcgtatttttgaggacggagaagatattattttccaggtggaggataacggaatcggtatgacggaagaacagtgccgggagattctgcgcaaagagccgggagaccgtaccggaatcggaatcaagaatgtaaatgaccggatcaagatttattttggaagcaattatggactgaatatcacaagtgagctggatgaaggaacctgtgtgacgatccgtatgccgaaggtcagggaggaagaatatgagaaaaagtagaagaaaaccatttattgcaattgatgcaggtgtgatcctacttgcaattctgttttttgtcctgacgggtgacggacttggggaaggaaaagaaggcagtacaaatagcgtcatcgagaagaaaaaagtagtgtttctgacaaaatccatggattcttctttctggcagtctgcatatgcgggagccggtgcggcaagtgcggaatataatctggatctggtgtgcgaaggaccggatggagacggtgaggaagattatgaggcgcagaatgaaatgatagaccgggcaatccgggaacaggtagatgcacttctgttctctgccattgattttgaaaagaatgcggaagcaatcgaccgtgcggcaaaggcaggaatcagaattgtggttgtggacagtccggtaaacagtgaggctgtggaatgctatattggtacagacaattatgaagccggatgtatggcaggagaagaagtgcttggtaatccggcggaaaatctaaatatcggaatcgtaaattttgataagagtacggagaacgggcagcttcgtgaaaagggattccgggatacggttcttaatgatgaccgggcaaatattacggcgtccatcaatgtgaagtctacgatcaccgacgcaagagagggcaccgagaggatgttgcttgacaatccgcagatcaatgtgatcgtgacatttaatgaatggacaacacttggagtcggggatgcggtagaagcacttggcgccggagagcggacgcaggttgttgcgtttgacagtaacgtaaaatccattggaatgctggaaaaaggaaatgtagatgcgctgatcgtccagaacccatatgcgatgggatacctggggattgagcagatcaatacactactgaatggtcagaagccggaaaagaaagagacagcaaccagcagtattctggtgacaagagaaaatatgtatgatgataagagccagaaggcgctgttttcatttgaagaaaagtaacgggtggaatgtttgtagctgctcggaagtatagaagctgtagtctgaaaaatatttggactacagctttttaaagaattgggcatttgaaacatttatggacgaaattaagtaaaaatttatataaacgttgaaattcacaaactcctcgtagtttttcacatgggtgttttattcccttcttgttatactcgtatcatcaagtaaacgttatacaaggaggaacgaaattatgaaaagaagaattgtagcagcgatgctcgcaggtgtgatggcacttggaatgcttgcaggatgcgggggctccggtaagagtgacagtgatggtggaagcagtgataagaaatcatcagacgctaatatcgcagtattctactatacctattctgatacttatatcgcatctgtccgtacagcactcgatgcaaaacttgacgagatgggtgttgaatatcaggactatgatggaaacagcaaccagacaacacagaacgaacagattgatacagcgatccagacaggtgctacagcactgatcgtcaacatcgttacatctggttctgtagatgcttcttctcagatcgttgaaaaagcagaagcagcaggaatcccggttattttctttaaccgtgcgatcgaagatgaaaagacagaaggcgatgtacttggaagctatgacaagtgtgcattcgtaggaacagacgctccggaagcaggacatatgcagggcgaaatgatcggtaactatgtagtagaacattttgatgaaatggatctcaacggagatggaaagatctcttacgcaatgttcatgggacagctcggaaatgcagaagctatttaccgtacacagtttgctgtagaagatgcagataagatcatcacagacgccggcaaaccggcacttgaatactttgacgcttctaacagtgacaaatatcaggttgaccaggatggtaactggagtgcaacagcagcaaataactatatgacaaccaacctttcccagtacaacgaaggaagcaataacatgatcgaacttgttatctgcaacaatgacggtatggcggagggtgcagtctcagctctgaatgataagggatacaaccttggaacaggcaaagactgcaagatgatcccggtatttggtgttgatgctacagacgcagcaaaacagctgatcgctgatggcaagatgacagcaactgttaaacaggatgcagatggtatggcagcttgtatcgcagaccttgctaagaatgcagcaggtggaaaagatctgatggatggaacagattcttacaatatttccgaaaaagtaagcaacaagatcttcattccttaccaggaatactcaggaaaataaaaatgtaaaaaataaaggtggcggccaggtggttggccagccaccttttctaaagttgtgacgcagccggatggaactgcatagcggcaggttcgaaaggtatgcgagattagaagatgagagacaggaggacagctatgaaacaggatgttttactgcagatgacggatatctgtaaagaatttccgggcgtaaaagcattagatcatgtgtccctgacagttaaagcaggcactgtccatgcactgatgggtgaaaatggagccggaaagtcaacactgatgaaatgccttttcggaatttatgacaaagacagtggcaagattgagctggagggaaaagagattaatttcaagaattcgaaagaagctcttgaaaatggagttgcaatggttcaccaggaactgaaccaggcgctcaaaagaaacgtcatggataatctctggctcggacgttacccgaaagtgggcggcgtcatggtaaatgagaaaaaaatctatgacgacacaaaaaaagtatttgaagaattgaaaattgatgtagatccaaaaaggatcatgagtacgatgccggtatcacagagacagatggtagagattgcaaaagcagtatctgtgaatgcaaaagtcatcgtatttgatgagccgacttcttctcttacagagcaggaagtagagcatctgtttgatatcattgagatgctgaaaaagagaggatgcggaatcatttacatttcacataaaatggcagagatcaaacggatttcagatgagatcacgatcatgcgtgacggaacctgggtagcaaccgagaaagcagatgatctggagatggatgatatcatccgcctgatggttggacgtgagcttaccaatcagttcccgccaaagacaaataaaccgggcgatgtagcgcttgaagtggaacacctttccggaatgtattcgatcctgaatgatgtttccttcaaagcaagaaaaggagaaattcttggaattgccggacttgacggaagtgggcgtacagaaactctggagacaatttttggaattgcaaccaggaaatcaggaacgataaaacttgacggaaaacaagtcagcaataagaatgcacaggattcgatcaagaacggatttgcacttctgacagaagagagaagagcaaccggtatcttcggcatcctgaacattcgtgaaaataccgttatctctagcttaaagagacacaaaaaaggattttatctgagtgaaaaatccatgaaagaagatacgcagaaatatattgatgcgctgcggacaaagacaccgtcgcaggagacaaagatccgtgcactttccggtggaaaccagcagaaggttatccttggaagatggcttcttaccgatccggaagtactgcttctggatgagccgacaagaggaatcgatgtcggtgcaaagtatgagatctatcagctcatcatcgatcttgcgaaccgcggcaaagtagttatcgtagtttcttcagaaatgccggagcttctcggaatctgtgaccgtatcatggttatgtccggtggaagacttgccggagagattgacgcagaagaggcgacacaggaactgatcatgacttacgcagcaaagtatgtgtaattttcaaacaaaaagaaggaggcttcccagatgaaagcatttgcaaatataaaatcacgctatgcagaatacaaagcactggattccgcagacaaggtaaaagcgtggaaagaaggacttatcaataatgcgatttatcttctgatcattatcgcagttatttacacttacacacagaacagcagattcctgagcgtggcatctattgttaacattatctcgctgtctgcagcgaacattccgatcgcgtgtggtattgcaggaacgatcgtacttaccggtacagacctttcagccggacgtgttgtaggtcttacagcatgtatttctgcatcacttttgcagtcagtaacttatgcaaccaaaattttcccggatcttccggttcttccgataccactggttattctgatcgtaatcgtagtcggaggtattgttggatgggtaaatggattcttcgtagcgaaattccacttacatccattcattgtaacactggcaacacagctgattgtatacggaattcttctgatgtacattatgctgaacggtaacaacggacagccactttccggactggacaaatcctttaagaattttgtaacaggaagtttcttaaagatccgtggcgttccgataccgaactatgtatggtacgcttgtgtcgtagttgtattcatgtggttcatgtggaataagacaacatttggaaagaatatgttcgcagttggttccaacccggaagctgccaatgtatctggtgtaaatgttatgagaacaaccattctggtacatacacttgcaggatgcatgtatggtatcactggattcattgaatctgcacgtatcggttccaaccaggcaaatacaggtctgaactacgagtgtgatgcgattgctgcctgtgtaatcggtggtgtatcttttgtaggtggtaccggtaagatcagcggcgttgttttaggggtgttcattctgagaatcatcttcgttgcactgcagttcctggcagtaagtcagaatatgcagtatgtgatcaaaggtctgattattctgatcgcatgtgcaattgatatgagaaaatatctggtaagaaaataaaaagaaaaggctgggaaatgttatggacgagaataagatgccggagaatgacggatggaagaaaaatgcaagactggcgatttatgcaatggccgggttttatctgctgacactggcataccagatgttcagggcgatttccacaagtcatggtaatgaacagcttgttatgatcgtggcgacgattctgtttctgatcgtaggtgttggactgatcgggtttggaactataaatgtctacaaaaatatgaaaaagaatcagagtacagataaagatcgtaatgaggaatagctcataacgaggacgagacctcaaaacaaaaagacaggagagtaatagcaccccctgtctttttgtgtctataaagaggaataaaaacattggaggaaaagatgaaaacaagaaaaaggtatgtccgtgccggggctgcctgccttgcggcattgctcacggtacagggaatgacattgcctgtggaggcaggtgaagaggtgaaagtaagatccaattcacagacacagatgagttcagatccggaagcggtttacgtaagcaattacgggaaatcgacggatcagagaacgatcaattttgacagtaactggaaattcaatctgggagatgtggaaaatgcgcagacagcaaatttcgacgactcgaaatggcgccaggtttcgcttccgcatgactacagcattgaacaggattattcaaaatctatggaagcagaaagtggatatcttccagggggaacaggatggtaccggaaaagttttaccatagataaagctgcggaaggaaaagagatccgtgttgattttagcggtgtttatatgaatgcatctgtatgggtaaatggagaaaagcttggaacacatccatacggatatacaccattttcatttgacataacagactatgtgaaatatggtgaggaaaatacaattgcagtaaaggtggagaacaagacgccttcaagcagatggtattccggaagtggtatttacagaagtgtaaatctgaccatgacagaaaaggttcatgtggatcttgaggggacgcagattacgactgagaacctgaaagcagaacagggtggaactgtcaatatggatgtccgcacacaggttgtgaatgattctgaagatgaacaggctgtaaccttgacgcacacggtatttccaaaaggcaaagatgaaagtgcagcaatcggaacagtgacaaccgaagctaaaactgttgcatccggagaaagtgatgaaatcgaaataacacttgaggcacaaagtccggcgctctggagtgtggacagtccgacactttatactgtaagaacagaagtaaagcttggagaaaatacagtagatgtttacgatacagaatatggtttccggtattttgattttgataacaatacaggattttcgctgaacggacagaatacaaaactaaaaggtgtatgtatgcatcatgatcagggagcacttggtgcaaaggcaaatgcccgcgcaattgcaagacagattgagatcctgaagcagatggggtgtaacacgattcgagtgacacataaccctgcagctgatgagctgatccaagcatgcaatgagcaggggatgttggtgatcgatgaagctttcgatacctggctttatgcaaaaaatggaaacagtaatgactatgcaaaatggttcaatcagaaaatcgacggggacaatcagattttaggtgcaggggacggtatgacctgggcacagtttgacctgacagcaatggtgaagagaggatacaatgcaccatcaatcattatgtggtctcttggaaatgaggttatggaaggaatcagcggtggcgtttccaattatccggcaactgcccagaaactggtgaactgggtaaaagagctggatgcaacaagaccgatgacaaccggagataacaagctgaaagccaactggagtgaagcagaaagtattggcaatacattaaatgcagcaggcggaaccgttggatttaactattgcgcaggctggcagtatgacaactggcataaattgcatccagaatggctgatgtacggttctgagactgcttctgcgatcaacagccgtggaatctataatcggatcaacggtggaagccagacttccgacaagcagcttacatcctatgataattctgctgtaggctggggcagtgtagcaagtgatgcatggtatacaacgattacaagagattaccttgcaggagaatatgtctggaccggatttgattatatcggtgagccgacaccttggaatggaaccggagcaggatcagtaggaagctggccggcaccgaagagctcttactttggtatcgtggataccgcaggctttgcgaaagacagctattacttctatcagagccagtggaatgatcaggtgcacaccttacatgtacttccggcatggaatgaaaatgtagtctataaagacaacagtggaaaggttccggtagttgtatattcggatgcagcatcggtcgagttgttctttacgccggcaggtggagaaagacagtctcttggaaagaaagcatttacacagaaaacaacagctgcaggttatacctatcagatttacgagggagaagataagaacggaaccgagcataagaatctttatcttacctggaaggttccgtatgcggatggaacactggaggccgttgcatatgacgcagatggaaatatcattgaaaatacagacggacgttccagcgtgacaacgactggcgaagctgcaaaattgcagatgtcagcagacagaaccgagattgctgcggatggaaaagatttatcttatgtgacagttgatgtgacagaccagaatggaaatattgttccggatgcagaaaaccgcgttacatttaacgtagaaggtgatggagttctggttggtgtagataacggaagctctccggatcacgattcttatcttgcagataacagaaaagcattcagtggaaaagttctggcaatcgtgcagtctacgaaaactggtggttcatttactgtgacagctacggcagatggactggaaagtgcagcagcaaccgtcacaacttattctgtatcagatggcacaccagaagaaaaagagatcgacagtttctggatgtcaaagacctattatgtcaagactggaaatatcccggtacttccgacaacgattgaaactcgttatactgatggaagcaaagaaagcaaagcagtgacatgggatgcgatcggagaggagatggtacagcagtcaggaaactttaatgtgcaggggcagattgaaggacatcaggtaacagtcaatgtaaatgttattgatgaagttggaggacttctgaattactcaacctcaacaccagttggaactgtaccgattcttccagaatccaggccggcggttcttacagacggaaccattctgaccgcttcatttggagtaaactgggatgatatatcggctgatcagtttgcagaagaaggaactgttacggtaaatgggacagcagatgtactcggtgatgaaattccggtaagtgcaacaatccgtgtacagacagagcagatcacagttggaagcagcgtgtccggaaaggtaatgaatctgacacagagcattccggaaggcgaacagtcagatacactttctgcaattgtggacggatcaacaacaatcagtgataacacaagtggaggagcaaacccgactgcatggagcaactggcagagttcccagaatggtaatagtaaagcagagatcacatttgagtatgcaacccagcagagacttggacagattgtgatgcattttgcaaaggacagcggaagtatgcgttatccggatgcaggaacaacagagattctggtttcagaggatggaaccaactggaacaagcttgcagtaacggagacgatcggggaagaaagtggacgggtaaaaccatatacgtatgatttcacaccgacgacagcgacttttatcaaattcaagcttacgaacgcaagtgtatcgacaggaaccggatggaaaccttgtactgcacttactgagatcgagttgaaggtggcacagggaagcttcgtatcgaatacgacagcgaagctggaagaagtcattgtaaatggcaatccggtaccggaaagtgcactggcacagggaagctattctacacctgctatttttgcagaggtagaggcaaaagcagccgataatgcgtcggtgactattcttccgactttcaacaatatcaagaagatcattgttgagtcagaggatcacaatacaagaaatgtatttgaaatccgtcttggagaagagacagaagagacaccagaatccggtgacagagattatccgattagaaggctcactgcatttgcagaaagtgagtataatggcagtggaacagaaggaccggcagagtacgttctggatgaagatgaaggaacgcactggcatacaaactggagtacaaatgatgcacaggatgtagaaaaacgctggatcggactggaactggaagaaccggcagttctggatgcatttcgctattatccgcgtggtggcaatatgaatggatttgtaagtgagtataaagtacagtacaaactgaatcagaaagatgaatggaccgatattgcaggcggtacctgggacaggacgcttgaatggaaaatagcagaatttgatgaaccggtagaagcaaaatatgtgagactggtgggaatccatacctatgcgaaatctgaaaatgatgcacacatggcagttgcagagcttcgtgtccgtgaggcggacaagcgtgtagatatttcggcagaagacagccagatcacagtgtcagttccagaacaaacagaggttgcgaaagcagatgaacagaatccggtatatccacaggtagaagtcaagagaacggtaaacggcgcagaagagactctgagatacggagtggattatctactgtcctatgaaaataatacagcttttggaacaggtaaggtaattgttaccggaattgtaaattaccgcggagttgtagagcgtacatttgaaattgtaaagaaagctccggagttaagtgctgtgtatatccagagtcagcccggaaagactgtttacaaatcaggagaaaccttcgatccgaccggtctttcgctgaaattggtatacgatgatgattcagaggaagaactggtatatagcgaagaaaccgcaggactgtttggttttgaaccaggtctggatactgcacttacagaagaagtaaaagaaattactgtggcttatggcggaaaatcagcagttgtgtttatcggagtagaatcgtcggaaaaaccaggacctgaaaagccggatccggagaatccgacaccgggaaaaccaaatccagagaaaccaaacccagaagatccaaaaccaggaaatggatccggcagtgagaacaatggtggaacaggcagtggaagcggatcaaattccaataacggaagcagtggtggtaataatacagtaaataacatcataaataataacaacaataataacagcaattcttccaataagaattcaggaaaagtgcagacaggagacagaaataatctggtattcccattaatcggaatgacagcagcaattctggcaatcgccactgttttaataatcagaaaaaagaaacgtctttaaaaatatagaagacatttaaaggactcccggcaaggtaaaatttgccgggagtatttattttcaaatctcaaaaaattcttaagaaaatcccgccctatctcttaaaaaatctctgctaatcttgtatagtatagaggaggtgaaaaagatggcgaaaatattagtatgtgatgatgataaagacattgtagaagcaatagatatttacctgacgcaggaaggatacgaagtcctgaaggcgtatgatggcgacgaagcgatcaaggtattgaaaagaaatgaagttgatcttctgattatggatgtgatgatgccgcggctggacggaatccgggcgacactcaagatccgggaaaatatgagtctcccgattattattttatccgccaaatcagaggatgcggacaagattttaggactgaatatcggtgcagatgattacatgaccaaaccgttcaatccgttggagctggtagcaagggtaaaatcccagctcagacgttacacccagcttggaagtacggcgagatctgacaaccagagtgagttccggaccgggggacttgtgatcagggatgatctgaaagaagtgactgtggacggcgaaaaagtgaagctgacaccgattgaatacaatatattactgttactcgttaaaaatcagggaaaggtgttctctatcaatcagatttacgaaaatatctggaatgaagaagcaatcggagcggacaataccgttgccgtacatatccgccatatccgggagaaaatcgaaatcaatccgaaagagccacgttacctgaaggtagtatggggtgtcggatataaggtagagaagatcggttaggaggtcttatgaataacaaatggtatcagagcgcaccatgtaaaggaatcctgatcgtactggagcatattttagcggtggtgatgatcacatgtctggtttttacattcagttatccgggcgataatctggcaggaatcctgcttgaaaagccacataagaagtatgaacagtcaaaagggtttaccgacaagctgatgagtgctgcaaatgatattacggctgcggaaggatacgacagcaattttgaaacagaaggaaaatatgatgaaaacagaattgtagatctgaaagaatatgattcagatcgtacgatttcaaatgaaaatgtaaatgggcttgcataccgtcttggtgatcttgtgaattactgggaaaacgatcaggagatgtactacgcagacgggaccaagatggcagatggagacaatgatgatgagatcatcgtctgccagaaggatgacggaacctaccattattactatgaaaaagaatttcgtcgggaatttaaaaacgggaaccttcagtttggtaatatggatgaggcaaaagatgaatattcactggaaagcaccggagaagtgatcgattctctgatcaatgactggatcgagagctccgcaagtatttaccgcaatattctggacagtgaaaatcgccaggtctacacaaagtgctggcggtatgacggagaaaaagtttccgaaaactgtgcaccggtgggcgcgaagaatcttctggaagttgtgaacaaggattccagatggaacggcaagttaagtgatgcgatgtccctgcttggaaatactgtggacagtgtacggaatgaatttttgacgtggcagtatgtaacggaagaatataaagaaggtaataccaatcttgcatatatgattgtagatctggacaataaaaaagtttataccaaccgtcttgcatatcagagatttgatgaatgggaaaagaatctggaaagtatgaaaaagctgggagtatatgcggttgccacaccaaagcttactgagtaccagagtgatattgatatggacggatcacagtggaaatcactgatcggtggcaatatgtggatggataattacgaatgcgtgttcgcggtagatacatcctatccaatccaggatgacttttatcaggagagcaagatttatcaggagtatgcaccgcaggtaagatttactttctggattgcgattgcaaccggatttgcaatgcttgtaattctggcatggctgacaattgttgcaggcagatcaaaccgggaagaaggcattgtgttaaatcgggtcgataaaatgaagacagaaatctttattcttttgtcggttgcagttatggtgatatgtatttatggggaaatcagtttaagttacggtctgctgaacggagtctggtttagcggagatggtttcaatggcacatcggtactgatttttgcagggattgttgcggtaagcgtttgcatgacaggacttactttctggcttggaatggtaagaaggatcaaggcaaagaccttgtggaagaacagtattttatgtctgatcatcaaatacgtccggattgggatccggcatctgggggaggtctggaaagctgcgattttgtttggagtactggttgtagttcactggatcgcgatcgctatgtgggagccgggaatctggctgttcgtaatgcttgcggcagaggcgggggcatttttctgcctgatgcgcagagccatcggaagagcgcggatcatcaaaggggtaaaagcaatcgcagacggtcaggttgattatcagattccgttaaatggactcaaaggcggacagcttgaagcagcagtcagcatcaataagatcggagatggactggaccgggcggtagaagagagcgtaaaaaatgaacgcctcaaaacggatctgatcacaaatgtatcccatgatatcaaaacgccgcttacatcaatcattaattatgtggaccttttaaagagagaggattttgaggatccgaagatccggaattatcttcaggttctggaagaaaaagcatatcgtctgaagacacttaccgaggatgtggtagaagcttccaaggtaagcagtggcaatatcagcctggaaatgatgaatctgaatctggttgagctggttaaccagaccagtgcagagtttgaagaaaaatttgaggcaaggaatctgaaaatgatcatgaatcttccgaccgaaccggcaacaatctacgcagacggcagacgaatgtggagagttcttgcaaatgtatttaacaatgcggcaaaatatgcaatggagggaagccgtgtatacgtggatctggttcagacaggtgaggaagtacagcttacgatcaagaatgtatcagagcagccgctgaatatttcggcagatgagctgacagaaagatttatccgcggagatgtatccagaagcacggaaggaagcgggcttggtctttcgattgcacagaatctgacaaagcttcaagggggaaaattcgagttatatctcgacggagatctgttcaaggtactgatccgtttcccggttccaaaagaaacggaagatgtctatcaggaagtcgaacagtaacaggtaaatatggggcgtaagggaaatttcccttgcgctctattttatttcgctttacaataaaaactggattcgtacatataacctaaaatgtaaggggaaattaaaatggaatcattgaataatatcttaaaaaagagtttaaataaagaatttttatcagcaataatcagcaatccacgtgaaaaaggcggaattgtaaagattaagatccgccctgtggagcataaagacaatattttgtaccagtgcgaagaacatcggaacaaccaggtatttcaccacaatctgaatgaagaagaagcagcaggatatattgaaaatgccatgcaggaattcaaacagatgcagatggagaccagaaaattccgctatcaggttctggtcagcaaaaaagggaaaatgacgattcagagacggcttcagaccgggaggttcaaagagattgatctgtcacacaaccggaagaagcattatatcctggaggaaggaaaagcagttccatttttacaggatctgggagttatgacaaaagaaggggaaaccgtgcggacaaagtttgataagttccgccagatcaaccgtttcctggagtttatcgaggatgttcttccggagctcccgaaggacagggaagtaacgattctggattttggatgcggtaaatcctatctgacatttgcaatttattattatttgcatgagttaaaaggttatgatatccggatcatcggactggatctgaagacggatgtcatttatgcatgcaaccagcttgcaaaaaaatatggctatagaaaactgaagtttatggaaggaaatattgcagattataccggctctgatgaagtggatatggtcgtgacgctgcatgcctgtgatacggctactgattttgcactggcaaaggcagttgggtggaaagcgaaagtcattctttccgttccctgctgtcaacatgagctgaatcgccagatggaaaatgagactttagcaccgttattttcttatggactgataaaggaaagaatggcagctcttgtcacagatgcgatacgtgcagaatatctcaagagggagggatatgacacacagatcctggagtttatcgatatggagcatacaccgaagaatattttgatacgggccatttacacgggaaataaaggaaaaaatacagaggcaatccgcacatgtgaagaaatgcttcacatcgatccaatgctggggagattattggatcagcagaatgaagagggagaaaaaggagtataaatttagcagattaagataaaggggactataattacaatgtttaaaaagatagcaataaagacaggggtactgactactgtatttattcttgcagttatcgtatccagttatgtgacgaacagaggcaacactgatatgagtgcagatatgggaggtgcgacactgccaagaatatcctttatgacagaaggatatgaagtgaactcactgccgggatataaaagcgatatgacgcttacttcaatgcgtgatacactgacacccgtcacaaataaccagctggatatgaacattgcaaaatatgataaccagatccagaaggtttactggcaggtatatacactgaatgggaaaaaatgtattcaggagggaaccattaaagatgttcaggatacagtaactttaaatttcaagaatatgaagatcctgaaagaagagagaattttgaaagtaaccttgtacctggataatcagaatatttatttttataccaggattaagaattcggcagattgcaactataagaaaagcctggatttcgcaaatgatttccacaatgcggcactcgaaaatcagggtgataaggtcgaaagctatttggaaacagattccagtgaggacagctccacctatcaggaggtcacacttgcatcgacacagtcacaggtgacatggggttcgcttgcaccgcaggtatcgggaaatgtatactgggaaattaaggaatgcaatgagaattacacatcacttgtcctcaaataccaggtaaagtgcaccggggatactgattatgctgatcggctttacagtgtaaaggaattcttccggatccgcaccggggaagatgcacaacagtatctgcttgattatgatcgcacgatgaatcagagatttgatggtaagacaactgcgctgaaccagaagggtgttcttgttgggattgcgccgacggacctggagtatgagactaatacagatggaaccattgtagcatttatagaggataaccagctctggcattatgataaaaaagaggatgaaatgtcactggtattcggcttcgcagatgcggaaaacatggatgtgcgtacattatgcgacctgcatgatatccgcctgatttcagtagatgaaaaaggcaataccacatttactgtagtgggttatatgaatcgcggtgtacatgaagggcaggtaggtgtagcagtctattattttgacgcagaaaaaaattccgttacggaaaaagcatttgtccctagcgaagacggatattatctgatgaaagaggatctgggtaaatttgtatattacagcaattctgatgaaaatctttatgtaatgatagatggtacattgtatcttgtgaatctgaaggacaacaccagagaggtgctggtgaaagatctggaggaagggcagtatcaggtttcaccagacggacatctgcttgcttaccagagtgagggcggaaagatcaatgagtcgcagaaaattatcgtgctgaatctgaagacgggcaaatcctttgatattacatccgaaggagacgaatatgtcaaaccgatcggatttatccggaatgattttgcctatggcatgctgcgtggaagcgatgcaggaaccaatatatccggacagagtgtgtacccgatgtataaagtggatatcatcacgcagaaacaggagatagccaagacctatgaggtacaggatttttacattctggatggctatgtggcagacaatatgatgacacttaatcgggtgaacagaaatgagaatacctatatttcaacaacggcagattatattaccaacaatcaggagaaggaagagagcaatatcacagttgagacctacaatgatgatctgcggggaactctggttcgtcttacttatgaaaatgggatcaaagacagcaaagcaaaaattttaaaaccaaagcaggtactgtttgataaaccgatggttgtcagctttgacaaaccgaaggtaaagaatcagtattatgtatatgcacttggcagtctgcagggggtgtatgaaaaagcatcttatgcgatccaggaagcggagaagataaaaggtgtggtcatttcttcatcacaggaatatgtatgggagtccggaaatacgccggatatttatgaagtaaataatatggatgagttccggacaggagaaggtgagagtacacttgcagcgtgcctgaaccggatcctgaagctggaaggcgcagaagatataaatgcatcaacagagctggaaaacggaaagtcgccggcagaaatcctgacagaagcaaccggtggagaaggatttgatctgaccggatgtacaccggaagaaatccgctatacgatcagccatgagacaccggtgatcgcaatgctcagtgtggatcacgcggtactggtcatcggatacacggatgcgaagtatgcttatctggatccggcagacggagaacgtcattcggctacgcccgaagagatggcgcaaatggtaagcggcagcggaaatgtattttttggttatgtaaaataaatttggaggacgcaaatgagagacgagaaatatttagaacttctggcagaaaaatacccaactgagcaggcggtctgccgagagattattaaccttaaagcaatcctcagcctgccaaaagggacagagcactttatgagtgatctgcatggagaatatgaggcattttgccatatattaaataactgctccggtgtgatccgggaaaaagtagatctgttgtttgaagatactttatcagatctggaccgggaagaaatctgtacgctgatctattatccagttgaaaagcttgcaatgataaaaaaggaaggaaaaaataatgaagagtggtatcgtgtgatcttaggagaactaatcgatatcgcaagattattttcatccaaatacacccgctcaaaagtaagaaaagcgatgccgaaggaatatgcctatattctggatgaactgatccatgtacagaaggatgaagatgataatcagctggtgtatcaccgcaatatcctgaatacgctccttgaactacagaatgcagatgaatttatcgaggtgcttgccggattgattaaacggctggcagtcgatcatctacatattgtcggagatatttttgacagaggtccttgtgcagaccggatcatggatttgcttacgacttatcactccattgatattgaatggggaaatcatgatatcctgtggatgggggcagcggcaggaagcagagcctgcatcgcaacagttatccgtaacaatctgaaatatgataatatgaagatcatggagaatagctatgggatcagtctgcgaaatctgaccttatttgcagaaaagatatacccgcagatcgatccgatggaagcggcactgaaagcaatttctgtacttctttttaagctggaaggccaggtgatcctgcgtaatccggattacaagatggaagataaattgctgcttcataaagtggatgtgaaacgtcaggttgttgaaattggcggaaaagaatataagatcaagaaggaagaatttccaactgtaagttttgcagctgaaagtgtggaagaagtctatcagctgaccgaagaggaagaaaatgtaatggaaggtcttcagatggcttttgtgaacagtatccgtctgagacagcatatagatttcctgtataaaaaaggaagtatgtaccggatcttcaacgataatcttctgtatcacggctgtgtgccgctggatgagagcggaaactttgacggcgttgtatttgggaagagatgctatcgaggaagagaatatctggactatgcagagcatgttgccagaagagcctggtcgaaggaggcgaaagaaaaagacagagactttatgtggtatctgtggtgcggaagaaagtctccactttccggaagaaatacgaaaacctttgagcgtacttatgtgctggatgagtcgacatggtatgaagaatcaaatccatattataaattttacgaagaagaaaaggtctgcaatatgattctgcatgagtttggcctttattccgagcgtgctcatatcattaatgggcatacaccggtcagaacttcaaaaggagagcatccggtccgtgcgaatggaaaattaatggtcattgatggaggtttctgcaagagctaccataagactaccggaattgccgggtatacactgatcttcaattcccatggtatccggatcaaatcccaccagcctttcctgagtgtgtatgcggcacttacggaaaataaggatatcgagtcaaaatcagaactggtcgagaccgaaaaagaacgtttgatggtgcgggatacagatagcggaaagaagatcaaggaggatattgaggcacttaaaatgctgctccgtgcataccgtgaaggggagttggaatagagtgaaaaagatttttgcatgcgctttatgtgttgtcatgacagttagtttatgcagctgtgcaggatgccggaaaaaggaagaaacaaaagcgaaagagaaagaaaccattgaattatggcattactgggatataccggataatcagagacatctggaagagctggtagagcagtttaataagatgcaggaggatattgagatagaagtatcttatattccggatgaagattttaaaaaacagcttgccctggcgatgtcggaagaaaagatgccggatattgccgtagtggactcttcggactttcaatttctacatcatatgaaagcgtttgctgatcttacagatgctattccggaattaaaggaatataacgaaaaagcattggaaccatgtacgatagatggaagaatttatgggcagccttttggtgtgaactgtacagggatgttctataataaaaaactcctggaagaaaatggatgcgaagttccggaaagctgggaagaatttcaagagacagcggcgaagatcagcaatgaagatgtaaaagggtttgcgatcactgctttacagacagaagaaagtatgtatgaatttctgccgatcttatggtcaatgggaggggacgtgtatagaattgcagaagaaaacagtaaaaaagcatttcttctgctggatcagatggaaaaagaaggaagtctgagtctgcagagcatttctcttaccatgggagatctgacaaatcagtttctaaaaggaaaaattgggatcatgttcaattcctctatggcgattgacagtatcagggaaggaaacccggatctggaattcggtgttgcaccgattccgggaggagagacatcggtttcggtagccggaggagaaattctggcagtagcggagaatgaaaagaaagagtatgcaatcaatgtcattaagttaatttaaaaattaaaaaaagcagaatgcaagtaggtaaaatctcacttgtattttgcttttttcattttgttatctgtttttttgcacggcaaacagacagatggattgtacatctgtctataatcctatataatgatgaatggttatgctaccctgtatagaaaacttactgacgcctgatgtttgactttccgagggtctcgacgcccaggtcttattggtaatatatgtttttctatcagtttaaccacatcaggtggacgaagtttccgtttgcgtcgcagatattctctgcaaatgtaaatggcaatagtaaagttcacctgatttttcttacttatattttctgtgtgttcaactacatatgttgtaattaattcgcagtaattatataaggtcaatcttgcaaatatttcttgctttatgtaatccacttttttggcatgaaaactagttagccctatagcatatttcaattcacgaaatgatgtttctatgccccatcttaagtgatataattccttaagtttttctgccgaaaagcaaaaacggtccaagtttgtaattaccgtttcataggaatcatctgctattttaaaccttgcaattctaaaggagataggataatcctctttgcttcctattggaagataatcaaaggtttgtactgttggcatgaatttatatcctgcttgtttctttgacttagtttgatttcgtgtcagaatcagattgatatccatatcaaaaactgccgtttgtggaagttctaagcctgatgcaatgccattgctgtgaacatcttttattctaatcaaaaatttccagcctttttctattgcgtgagacataatgttatagttttcatatcctctatcagcaattaatataactttgtccaatgtcaccctttctatcatttgaatgcatgctctgtgttcttgatacgtagaggcagtttgaaccaatgcatcaatataagttctgtttaaaacatcatacagggcatttagatgtaagtgattaccggttgcaccaagttgatttgatttccaaagagtttccgggtcgtttagattcggtgcaatagttagattgctgccatcgcaagccaaaagttgatatccctcatataagttttttgtttgagcattttcttctgtaaacgcatgaaataagtattcaaatgcttctggtagaattttagcccgctgctgtgtatacgctgaaacagtaggagcattcacatcaaaatcgaaaaaatccaagagttctttattcagcgtgcaaccgccggaattcatggtaatgccaacacatgtcttaaaattaattttgcggtttcttgaaaaatcagtatctggatttttcaagaacaaagatggatttcttgccaattctgaaattagattttctagtgaaaccgtaaccttttcaatatagtgactcataatgtatcctccttgcaatcaagatattccttaattacaagggccgctttcgcaaccttaatatatatcggtagcgaaagcggccgcacattctatcttgtttgtcaactatttttacaaaataaaaagactcctatattatttctaatataagaatctaattatttttccttaacttaatgacattgagtatgcaatccgttttttaaagtttctggcagataaagaccgaatgaaagaatatattgatgcatttggttttcttgcaccgcgtcaggatattatggaacaacaatttgccgaagatccggaaaagagaacatttataaaaatgtataaggctgccgggattcgtgagatttctccggaatggccacggatttccctgacactttccgatactctgagacagatactggtggaggaagaggatccgcagacaatattgaataaaagtgcagaaaagatagagaaaatcggagcagagaaatgaaaaagaaaaatctgagacaaattctgattcctgcatttattattacggcatgcattccgatcactatttttacagtgatatcgcaggcacgtctgaaaaaaagcacccttgataatatgaacaatcaggcagaggcagatcttcagaagtcaaatcagtgtctgaatatgacattggataagtatgagacgattctgtatgatatcactacggctgaagactttttaaatcttgcggttaccgcgaaagaatctgctgatattatggagacagatgcctataatatgcgaagtgaattttcacatatctgtaacagaaatcagggtgtggacgggattcagctggtattggcagatagaaaaagaatcttttatgacaggctttcttcttcttcggtgaacagttcctggattgaaaaggttgcagttccggagacagaagagatgctgtcttatacgatggatcaagagaatgaaaatccggaaaggatgtttcatatcagccgtaaggtagtaaattactgggatatcagtgaagatctgggagaagtgattctgtcagtcgatgcagatgaactgagttccgtgctggatgttggaaaaggatcggaaatatatctgatagatgacggaaggatcgtcggagcggaaaatgaaaaattactgggcaggacggaagatattttagagacgaaaagggtcagtcaaaaatccattacaaatacccggagcggctgggaaatcgtattgtgccagtcgctgagtgaatatcagagagcaatcagagaacagatcgtattctggctgctgctggcagtggcagtgctgcttgtttttgtatttctgatctataaagttacagaaccggtcatggtatcggtaaatgagattgtagatgcgatgaaaaatctggagaaagataatttcagggagaagcttgcaatcaaagaaaatgacagtatagaaatacagaagatatcggaaggcttcaatgatatgactgagcggatctatcatttgatcggtcaggtgaaacaatctgcattggagcagaagaatgcagaaatctcagcgttggaggcacagatcgatcctcattttctatataatatcctggataccatcaactggaaagccattgaaaatgagcagtatgaaatcagtgagatgttagtggcgcttgccgaaatcctgcgttatgccattaatgatgcaggggaactgacaacgatcgaagcggaaaaggtatggctggaaaagtatattcttctgcagcaggaaaaattaggagaaaaaatcgagctgatatttaaaataccggaggaattggaaacttataaaattcataaaatgctgcttcagccttttgtggaaaatgcgatcaagtacagtttccgcggatgtaagggcgaacaccggcttaccatcgaagctgtgaaggcagaagaacaattacatctgatcattgtaaataatgggcagtgtattgagaaagtcagattaaaagaactcaatgaaggaacgaagataaagaatcatctcggaatttccaatgtgagaaagcggttggaactctattacggagaagatacagcagtttattttgaaaatattctttcgggtggcgtgaaagtacatttatttattccgatacagggaggaaatgacgatgcggatagcagtcattgaagacgagagaccgattcgtgaggggcttgtacatattttgaataaaatcagtccggaataccaggtggtaggaagcgcggaaaatgggcgagaaggtttaattcttcttgaagaacaggatccggatctgatcctgcttgatatccagatgccggatatgaacggtctgcagatgttaaaagaagcaagagaaagaggaagtatgactaaggttgtgattcttacggcatactctgactttgattatgcaaaaaaggcaattgcactcggaatagaaaattatctgctaaagccggttaatcttacggaactgaagaacaccctttctaaaatcaaggaagagatattcgtagaacagagagggaaaaattctctttcacttgaaacggtcataaaagatgcgttagaaggcgagtatgaagaggattctaggttagaggagacgcttttggagaaatatgggttctccggcagaaaacaaatttactgtatgtatctttttatgggaaagtattatgattccgaacaaaaagaagcagagctttttttagaagaattccgggaacataatccggacaaaaaaatgtgctggttatggagagagaagaggcagtctgtttttatctgtttttatgatgtgaaagcaaaaaaaaattttatacagtatttgaagcaatcggtagtaccggctttttctatgagaatccatgatcatggggcatttgcgggaaaagagtgtcaagggttgggagaactggcggagattgaaaatgcgctgaccgaagcatgcggatggcatttaatacttggcaaccgggtattgatcaagtgcaaaaaaatcgcgcaactgaggacaaatcgttttacttatccggcagatctggagaatcaggcaaggagtgcggtaatccatctggattatcctgcgtttacccggtgctttcagcaatttatggaggcaggattacgtgaagtccacagcccgcaggaaatcagagaggtttgtatccgttttgcttacgctgtgatcaatacggcaaaagagtgtggaacattacgggatgaagatctgcttgtccaaaaaatattacatacgattttaaatgctgttttctgggaagaaatcatggatgcaatgctggaattatttgcctgcatagaaaatgatgaaaaaaaacagacttcggcagagcttctggtacagaaagctctttctattattaaagaatgctacagtgacggaatcaatctggaggaaacagccaggagactgcatgttaccgaacagtatctgggtacacagttaaaaaaagaaacaggctcttcttttacggagatcataaggcgatataaaatcgcacatgtaaaacaattacttctggatacggaattaaagctgaatcagattgcttcaatggcaggtttttcggatcccaagtacatgagtaaggtgtttaaacaggaagtagggatgcttccgaacgaatatcggaggatgaatacataatcagtttgtaaaattcctctttttataaaaaatttctcctttttaaaaatctgaatttgctatagtaggttcagaaattgagaagaggaggaagtaagatggaagcagccgaaaaaatttccgtcggagtaattaaagaaaaaacaaaaagtaaagcagtcaaaaaagaagcagaaggtatgcgggtttccaccagagaaaaagtctgttacggagttggtgatatcggagcaaaccttgtgtggacaacggtagcttcattcctgacgatttactgtacagatgtggcaggaattgcagcaggagtagtcggaaccctgatgctgatcgcaagattgtttgatggagtatccgatctttttatgggtgttattatcgataagacaaataccagatggggaaaggctcgtccgtgggtattatggagtgcacctccgcttgttgtcagtctgattatgatttttacagttccgaatatcggagcaaacggaaaagcaatttatatgctgcttgtatatattttccttgcagcagtttgttttactgcatcaaatctttcttacaataccatgctttcgctggtaacaaccgagcagcatgaccgaaatgtaatgaatacaatccggtttgaatttacaatgatcgcacagctggtaatcaatgtgattacgattccgctggtacatttccttggaaacggccagaagggctggacctgcatgagtattatttatgcgatcgtagcacttggaatgtttattacaacatttgccggaacaaaagaaagatataaaccgatcaaaccggaagtgactgaaaagaagaaaacacacccgattaagactattaaaattctttgcagcaataaatactttattctgatcacattagcatttgcaattatttatacatcactcggacttaccggtggatcaagaatttattatgcaaaatatgtacttggcaatgagatgatcaacagtacaatgacattatttaactatatcccaacgatccttacgatcatgctgatccctatttttgcaaaaaaatttggaaagatcaaagcattatttgtgggcttcctgttctatggagcaggacttattcttgaaattgcaggaccggtcaatcttccgatgatttatggaggactggttttacagggaattggtcatgcggcattgtattcctgcctgttcgcaattgttggagacgtagtggattacagtgaatggaaagacggaatccgagaagaaggacttacttacagtgtaaccagctttggacagaaaatcggaacaggtcttgggacagcagcacttggatggatccttgcggcaggaaattataatggaacggcagctgttcagccggacagtgcgatctttgcaattaagagtctgttcttatatctgccactggctatcacagtcgttgttttaatcatctggtatttatttatgggaatcgataaggtatatccgacagtcagaaaagaactggatgaacgtagaaaaaacgcaaaacagaattagaaatataagataaatagtaatagtaaaaggatcggatggcagttcgccatccggtcctttttgtaatagaaaattattttgtcataacgacagcgccatcatccgtaatgcggaccatgtattctacctgagcagaaagtccgtcatcttcggtataaaccgtccagtcattgtcttcatcaacaaagaattccggactgccttcgttaatcatcggttcgatggtaaagatcatacccggaaccagaagcatttcgcttccctttggtgtaacatagcttacccaaggttcttcgtggaattcaagaccaacaccatgtccgccgatttcctctacaacagaataaccatttgcttttgcatgtgaattgatcgcatctgcaatgtctccgagatggttccatggttttgcctgcgcaagtccaagttcgacacattcctgtgtgacacgaaccagtttttcggcacgttcgctgaccttgccgatcataaacatacgggatgcatctgagaaatatccgtccagaatggtagatacatccacattgatgatatcgccttcttccagaataatattttcatccggaataccatggcagatctcgttgttaatagaagtacacacactctttgggaatccctgataattaagcggtgccgggattccgccgtgttcggttgtatagtcataaactaatttatcaatttcggctgtactcatgcctgcgtggatatgagcagctacatgatcaagtacggcagtattgagatctgcacttttctggattccttcaatctgaggaatggtcttgagcatatctcttgtcggaacgatttctcctttatctgcatgatatgcgatcttttcttcgatcataagatggcattttttgtatttttttccgctgccacaccagcacaattcatttctttccatgagaatacctgactttcttttataaatttttacgtgcagagtttgatgtgatcacaaaaaatcagatgtatgcctgcactaactgtttcacttctataatatatccattccggaacaaaaagtcaatctgtgctgtgcatttcgccagatgtgattcaaaatgacagaccaggatgcggtatgtatcggttttgcagcagaactattgcttgtataggactcgggaatcggttataatacaaagggattataactgaaaataacagactgatctggaaaagatgaacagggaaaggatggacaattatgtttagaattggaatgcttaccagtggtggggattgtcaggcactgaatgcagccatgcgaggtgtcgtaaaaggactttgttcaaaacgaaacgatgtggaaatttatggatttcaggatggatataaaggacttatttattcgaactttgagatgctgacagcaaaagatttttcgggaatactgacgatgggtggaacaatcctcggaacatccagacagccgtttaaactgatgcgcgtacctggaccggatgggatcgataaggtcgaagcgatgaagcatacttatcacaagttgaatctgaactgcctagtagtactgggaggaaatggaacacataagactgcgaatctgttaagagaagaaggactgaatgtgattacacttccgaagacgatcgacaacgatctgtggggaacagatatgacatttggctttcagagtgcggtagatatcgcaacggaagcaattgacagaatccatacaactgcaacttcacacagccgtgtatttattgtagaggttatggggcataaagtaggatgggtaacacttcatgccggaatcgcaggcggagcagatattattcttctcccggagatcccgtatgatgtggataacgtagtgcgtgcgatcaagagccgtacagaggcaggaaagcattttacgatcatcgcggttgcagaaggcgcgatcacaaaagaagatgcagcccttccgaagaaaaaattaaaagaaaaacaggaaaagaagggctatccgtctgtggcatatgagcttgcagagaagatccagaaccgtatggatcaggaggttcgtatcacagtgccgggacatacgcagagaggtggaagcccgtgtccgtatgaccgtgtgcttgcaaccagacttggagcagcagcagcagacctgatcttaaaagaggactacggatatatggtaggaatcaagaacggcaacatccgcaaggttccgcttggagaggttgccggaaagctgaagatggtagatccgaaagcggatatcatcaaagaagccaagattgtcggaatcagttttggcgatgagtaaaggagtaatttaacatgtcatatactgccctgtatcgtaaattccgtcctgcggaatttgaagacgtaaaaggacaagatcatattatcacaacgctgaagaatcagataaaggcggacaggatcggacatgcatatctgttctgtggcacaagaggaaccggaaagacaacagtagcgaagatttttgcaaaggcagtcaattgcgagcatccggtagacggaagtccctgcggggaatgtaccatgtgcaaaaatattgcagccggtacttccatgaacgtcattgagatcgatgcggcttccaacaatggtgtggacaatatccgtgagatcagggaagaggtatcctatcgtccgacggagggaagatataaggtgtatatcatcgatgaggtgcatatgctttcaataggtgcatttaatgctctgttaaagactttggaagaacccccggaatatgtaatctttattcttgcaacgacagaggcacataagattccgatcacgattttatccagatgccagcgctacgatttcaagcgtattacgatcgatacgatcgcagcgcggttggatgaactgatgaaaaaagaacaagttgaggtagaagaaaaagcaatccgctatattgcgaaagcggcggacggatccatgcgagatgcactaagtcttctggatcagtgcattgcgttttacctcggacagaagctgacctacgatcatgttcttgaggttcttggcgcggtggatacggatgtattcagccggcttctcagacagatcatcagccaggatgtgggaaaggtacttgctaccgtagaagagcttgtgatgcagggaagagaactgacgcagcttgcggcagattttacctggtatctgcgcaaccttcttctggtgaagacttcggataatatggaagatgtgctggatgtatcgacggagaatctggcgcagctgaaagaggaagcacagatgatcgaatccggggtgctgctccggtatattcgtattttttccgagctgacaaatcagctcaaatacgcaacacagaaaagagtgcttctggaagtaacactgatcaagctttgcaaaccgcagatggagagtacgaaggacagtcttctggaccggatccgtgcactggaaaaacaggtagaagaaggaagttttgcagttgcgcagccacaggagagggttgtttatgtaaatggtgaagcaccgaagccacagccaaaaccgcagcttccgaaagcactgaaggaagatgtaaagcaggtgacatccaatttccggaagattgcaaacgaagcatcaggaatgcttagaggctatctgaagcaggcaagactcagcgtggacaatcaggacagacttctgatcgttctgccggatgagatcagcgccagcgtggtaggaagcgaagaacataagcaggaattaaaagatctgattgagaaaaaaatcggcaagactgtggagattgatgtgcgtcaggtggagaacggacgccattttgaagacagttttgtggatatagaaaaagtgatcaatatggagatcacgattgaagatgaataataattaggaggatttatagttatggcaaaaagaggaggatttccaggaggcggaatgccgggaaatatggcaaatttaatgaagcaggctcagaagatgcagaagcagatggaagagcaggcaaaagagatggaagagaaaagttttacagcaactgcaggcggcggagctgtagaagtgaccgtaagcggtaaaaaagaagtccagaaagtaaaacttcaggaagaagttgtggatccggatgatgtagagatgctggaagacctgatcatggcagcagtcaatgaagcacttcgtcaggtcgatgaggcaaatacttccgctatgagcaagctgactggcggacttggcggaatgccgggaatgttctagaacgggagtgtaaaagatggattattacagcagtcagatcagtaaactgatcgaagaattatcaagactgcctggtatcggagcaaagtcagccggaaggctggcttttcatatcattaatatgccgaaggaacaggtagaacagcttgcagcgacactggtagatgcaagaaataatgtaagatactgcaagcaatgctgcacgcttactgacaaagaattatgcccgatctgtgccagcgaggagcgggatcataagacgatcatggttgtggaaaattcccgagatcttgcagcttatgaaaagactggaaaatataacggtgtgtaccatgtacttcatggcgcaatttccccgatgcttgggatcggacctggagatatccggctaaaagagctgatggagcgtcttcagggggatgtggatgaagtgatcatcgcaaccaattccagcctggaaggggagactactgcgatgtatatcagcaaactgatcaagccgacaggaatcaaggtcagccggatcgcaagcggcgtgccggtcggcggcgatctggaatatattgatgaagtgacgcttctgcgtgcactggaaggacgtacagcactttaagtgacttaacgtgacttaaggactgcgaggagtgccggaaacgtatgcatttgaaagaagtaaagatatgagaaagaagaaagtaacctcttcggatatcgcacatgcggcaggtgtgtcgcaggcaacggtatccatgatcctgaataaaaaatataatgtatcattttcaaaagaaacgatccgtaaagtggaacagatcgcagaagagatgggatacgaagtaccgaaaagaaagacccgcagagaaagcagaaaagaaaaactgatcgtcgtattttgttccaacctcacgaacccttattatgttatgttgcttcaggggattgaatcccgtgcaaaggagcagggatatggactgtttgtgtgcaatacccagagggatctgaagatggaggagcggtatctcaggatgatgcatgagctgaaaccgcttggcattatctatacctgcaatccaagccattgttttatggatacgatagaagggttggcagaaaaaattccgatcgtaattatcaataaccagaatgagcatctgaatgtagatgcagtggaactggataattccaaactcggaaggatgatggcaaagcatcttctggagctggggcatcggaaagtagcgtatattgcaccacctcttacaaccagacaaaagcagcgctcaaaaagggtggaaggatttctgaaagaatttgatgctgttggattaaaaggcaatgtgatcatcaaggcagcaaatgagtcgatcgatatgagcatcccgaatatcgattcggagtataagatcggatatgatctgacgaaagagcttttgagagagcataatgatattactgcgatcgtcggattaaatgatatgatcgcatttggaatcctggatgcacttcacgaagaaaaatataaagttccggcagatatttccgtaatgggatgtgataatacactgtttgcaaagatgcataaggtgtcgctgacaacgatcgagcattttgtcgttttcaaagggcgggatgcctgtgatatcattatgaaaaagattctttctcagaacagccagtattcagagatccagccgatcagcacctaccatgtagaatatgaacctcgtctgattgtgcgtggaacgacgtcttatgcgaaaacaaaaaaagggaaaaattagtttaaattcaaaaaatattagtaatatttcatagtttatgtctctgaaaacgctataaaataaagaattatccaaaaacggcatcaaaaaattactaataaaatagttaatattaacgtgaaaaattactaataaaaacatatggctattgacctgtcagagtaaattgcgatataatttaaccaagtcaggcaatcagataaaaagagagattcctgataacgggaaatacgaattttcatgttcataaggaggaaaacgaaatgagatttttcatcgacacagcaaatgtggaagacattaaaaaagctaacgatatgggagttatctgcggagttacaacaaatccgtcactgatcgcaaaagagggacgtgattttaaagaagttatcgcagagatcgcatctatcgtagacggaccgatcagtggagaagtaaaagcaacaactactgatgcagaaggtatgattgcagaaggtagagaaatcgctaagatccatccgaacatggtagttaaaattccgatgactgtagaaggactgaaagcttgtaaagctcttacagctgaaggaatcaagacaaatgtaacactggtattcacagcaaaccaggcacttcttgcagcaagagcaggggctacatatgtatcgccgttccttggacgtctggatgatatttctgtacgtggaacagaactgatcgaagaaatcgctgagatgtttgcagcggccggagatattaatacacagatcatctgcgcgagcgtccgtaacccaatgcacgttacagaatgtgcacttgcaggtgctgatattgcaactgttccttacaaagtaattgaacagatgacacatcatccgcttacagatgctggtatcgcaaaattccaggctgattacaaagcagtattcggagaataaaatttacaatcggaataatttactgtcggaagagcatcaatttgcgcttccgacaaagtgactaaaaataaactatttcaggaggcatattttcatgaacaagtcagaacttatgaaaactgcaaatgaaatccgtaagagcatcgtgacagcagtacacgctgccaaatccggacatccgggcggatctctgtcagcagcagacatctacacatatttatattttgaagagttaaatatcgatcctaaggatcctaagaaagcagaccgcgaccgtttcgttctttccaaaggacatacagctccgggatactattctgcactggcacacagaggattcttcccggtagaagacctcaagacacttcgtcatacaggatcttaccttcagggacatccggatatgaagcacatcccgggtgttgatatgtcaagcggatctctgggacagggaatctcagcagcagtaggtatggctatttctgcaaaactgagtaatgatgactatcgtgtatacacacttctcggagatggagaaattcaggaaggacaggtttgggaagcttctatgttagcaggcttcagaaaactggacaatttggtagtaattgtagataataacaaccttcagattgacggacgtattgatgaagttaactcaccatacccgatcgacaagaaatttgaagcatttaacttccacgtaatcaatatcgatggacatgattttgatcagattgcagctgctttcaaagaagcaagagaaacaaaaggaatgccgacagctattattgccaagaccataaaaggtaaaggtgtttctttcatggaagaccaggctggatggcatggaaaagctccgaatgatgaagaatacaagatcgctatggaagatttagagaaagcaggtgaagcattatgtcagaagtaaagaaaatcgcaacaagagaaagctatggtaatgctttagttgaacttggaaaactgcatgatgatgtagtagtacttgatgctgaccttgccggagctacaaagacaggaatgtttaagaaagcattcccggaaagatttatcgactgtggtatcgcagaaggcaacatgatcggagttgcagctggtatcgctacaacaggcaaagttccgtttgcaagtacatttgcaatgtttgcagcaggacgtgcattcgaacaggttcgtaactctgtcggatatccgaagaacaatgttaagatcggtgctacacatgcaggtatttccgttggtgaagatggtgctacccatcagtgcaacgaagatatcgctcttatgagaacaatcccaggtatggtagtgatcagcccggcagatgatgtagaagcaagagcagctgtatttgcagcatatgaacatcagggaccggtatatatgcgtttcggaagacttgcagtgccggtaatcaatgataatccggattataagtttgagatcggaaaaggaatcgtacttcgcgaaggtaaagatgtaacaatcgttgcaacaggacttgaagtgagcgaatctcttgcagcagctgaaaagcttgcagcagacggaatcgatgcgaaagtaatcaatatccatacgatcaaacctattgatgaagaacttattgttgcagcagcaaaagagacaggaaaagttgttaccgtagaagaacattctgttatcggtggacttggaagtgctgtatgtgatgtgctttctgaaaaacttcctacacctgttctgaagattggtgttatggatacgttcggggaatctggtccggcagttgaactgatcaagaagtacggacttgatgcagacagcatctgcgaaaaagtaaaagcatttgtaaaataataaaaaaggattctgagaatctataataaaaatgccagaaccggtgtaaatcgggactggcatttttgttatggatgaaaggaaagttcttgatccgctgtgggagtgagaaggatatagcaccagaccagtggcactataaccagttatattttgagagtggcatatttcccgttctaggaaaatattttccgtataatacagcttacaagtccaattccgcataatggaagaaggattcctttcagacttccatacagctgcagaccgctggcaagaccggtcagtggtgatggagaagaaggaatcagattccagaacattccggcagcaattacagttataccgatgaacaggaaagagaaaagcccccgtccggtatcgacacgctttgttcccctgtctccataagcacatggtccggtcagcgcccacaggaagaaaataatctccataatcagcagaaatgttgcgacgccaaggaaggcaccgagcgtataattcttggcatttaccgctgtggcaagtgaaccatataccggataacagctccagaaattcttgaaaatattaaatgcaattacggcgatcatcagaagcgttacgccacgggctccggtctgcaggagtttgccggttatttttgcgcctgtctgcacggtctttttcaccggagtggtgatgatcgaagcggatggagtggaacgctttttcacggaagcttttgaactgccgtttccagagtttccggaagtacgtttccgggcttttttagaccgcttctttcgtgaatcctctgaaggatcttcggtggaagcgtgctccttcttttttacttcctcgcttttgttggttttatttacatctctttgagatttctttttacgcctttttacggtatcccgatccggtacgtcatccagatcaatgatatcaaagtcagtatcgtctgacaggtcttcataaatctgtttcatgttacaatcagcctcctcatttttgttccgccctattttataccaggaatttgaaagaaacaatatgaatcacagaaacatcacaaaatcataaggaattctttagaaaagaatgaggtgaaacaaaagaaattttggtatacttaaagtatgccggggaaaggaacacggcagaaaaaaagagggtaaccagaatggaaaaattacagaaaacgataactgaattaaatgataaattaaaaaagaaaaataaaacaccggaggagcaggatgaagaatttgaacagttttatgaatgtatcaaagatattgcaacccatccggtagtgctgagaatgaagctttatccgcatcatggagtgacaaactgttatcagcactgtcttcatgtttcttactataattatatctggtgtaaggcacttggactggatgcaaggtcagcagcgcgtgcgggaatgctgcatgatttgtttttgtacgactggcatacccatgcaaagcggacaggggatcattttcatgggatgacgcatccgaaaagagcgctcatgaacgcagagaaattttttgatctgaatagcatcgaacgggatattatcatgaaccatatgtggccggtcacacttttttctgtgccgcggacaaaagaaggatggattacgacacttgctgacaagtattgcggcagttttgagactgcacagcggaaagagagcgatccggtaaagaaaaaacggggaatggacaggattgtcgaacgattttcctatttagtagacacaaagcgataaaaagtgtgctttccatatgatacgatagcctaaactacaaaatatgcagaatgaggtgagagtattatggaaaacaaatttccaaaaaatgtacgtcagataggaaatgtgagtgatactccgaagatttacgtggaagattatgtagatacatttctgaatcagatttgtgataaagcagataaggaacaggcaggtgcatttctggtcggtaaaaaagaagtaacagaaggacaggagtgtctctatatttttggcgcgatctgcatggaattttccggtgatgaaaatgaaatcatttcacaggagaattttgaaaaagcagagcaggagaaaaaggaatattttgaagagggtacgatgattggctggatgctctgcagaccgggcgtgcgaatggtgatagatacgaagatattcaatacccatgaaaaatatttttccgaaagaaatactattttcatattaaaagataatgcagaggtggaagaacagtattattgttacaaatataaagagctgatgcagattggcgggcattatgtttattatgaaaaaaatgctgcaatgcagagttatatgattacggcacggaaaaagattggcgtgacacccagtgaagttgtggaagataaggctgcaaaagactttcgcaaccttgtaaaagaaagatttgaggcgcaggaacagaagaaaacttccaggctgacatacgtggcgagcgtgtttctggtaattgtggttctgatcatgggtgtgacaaccctgaacaattatgggaaaatgaaaagtgtccagtcatccctggaatttatacgtaattcgatcatgaagcagggcgaggaaaaaacgcagaaaaccagtggcacagtaaaagcagcaaatgagcaacaaaatgagaataccgttcagtcagagcagacgaatgatccgcagacagaggaacagcaggatccgatgccacagcagggagagggctctgattctgcttcgacagaggaagaaaaggtcgatgattcttcgatgagcacaatgcaggaaatgagtgaagatatttatattgtagaaaaaggcgatacgctagccaaaatcagcaagaaagtatacggggacagtggacatgtagatgcgatctgcagaatgaacgggttgtcggacggaaacctgatttttatcggacagaaattgattctgccgtagttttctgtacatatgaataaaaactgtggtatactaacaacaaactaacgacaggaaaaggacaggttatggatgtgatagtaaaggtacgtgatccggaagaaaacctggaagagaagataaaggcgtacaaagtaaaaaagagaataaagacggcggcaacgattttggcgtttgtgtttgcactgatcagcagctatctgcttgtgaaattgcagacatatacaagcctacggactttgcaaagctataaaaataaagagacagaatcaagtgatctgaaatatttgcaatatgcagacggaatgctcaaatacggacgggatggaattgcgtatatcaataaaaaaggtgtagagcagtggaaccagtcttatcagattaaggatccggttatcaatgtgtcgggaaaagcgatggcggtcgcagagcgcggtggaaatgatatttatgttatggatgaaaaaggcgcgaagggagaaatccatacgaattatccgatcgagaagatagctgttgcggaaaatggaattgtcagtacgattttaaataacgaaaattcaccaatggttgtgtgctatgatgcgacaggaaatgtactggtagagcacagagcttcacttaccggaaccggatacccgattggaatcgcactttcgccgaacggaacgagacttcagatttcatatttgtgtgtagcggatggtgtcgaggcaacaagagtcggatacctgaattttgataatacagaagaagcaaacaaagaatatcaggttgctgatgatgtttacaaaaacacaattgttccgacttcgttttttatagatgagaagaagtctgttctggtcggagatcagtcgtttatgatctataaggaaacggacaagccaaagctttctaaaacagtaaagctggataagcagattaaaagctttttccatgacgatgaatatcttgggttcatactgaaagaagaaagcggagaatatgagcttcgcctatatgatatggaaggaaatcagaaattatctaaaacatttaccggggaatatggaaatgtaaagattgcagatggaaatgttatcatgtatgatgggacttcttgcctgatttattccaagcttggtgtgaagcaatttgaaggaacgacagaatatgagataaaagaagtaattccgattttcggaatcaataagtacctagtgatgaatgcagacggacttgcagaggtacggcttgtaaaataggagtagagtatggaagtaaatattttattggtaattgtcgggggcattatagcaataggagccattgtaggatttgccaaaggtgctgtcaggattgctgtatcgcttggggcgacgatccttacgctggcggttgtgtattttgcaacgccgtatgtcagcaaagcaatttattcgcttacaccgattgatgagatggtagaacagcagtgtataaaaacgatgacaaaagccttcgcgggagaagcggatacaaattcgggatttacggaagagcaggtacggggaatcctctcagcggcaggtgtatctgagcagacattggaagcagcaggaattaccgtggaagatattgtaaatggtaatgtgtcagatgagatgctgcaacagtatggaatttcaccaaatatcttcgatggacatgtgtcaacggaagaggcagagcagtcgatcatggaggctgaggttccaaagcaaatgcagatagtggcaatcgagggggcagatcttccggatgtatttaagaatcttcttctggaaaataataacagtgaagtttatcagaagcttggggtaacgacatttgcggaatatgtaagcaaatattttgcaaagctggttatcgagattgtcgcatttctggtaacattcctgtttgcaaccattgtgataagagcggttgtgtttgcgcttgattttgtgacagcacttccggttctgggaattctgaacaggctggcaggagttctggtagggtcgacgatttcatttattatagtagggatcctgtttatcgtaattacgcttctgtatacaacaacgataggaaagcaggcaatgggaatgatcagagaagatcagattcttagttttttatatgataataatataattatgaaaattgcaacaatgttgagataaaaggcttgacaatagaaactgataatggtattataaaaatctgtcacggaaaagtgatggatttttatttataataagggatgtaaggtagcctttgaaaataaaaataaaaacctcaaaaaatgtgttgacaaaacaaaatacacatgatattatatagaggttgtcgctgataaaaatagaaagcgacaaaaaataatttaaaaaagttgttgacaaacacgaaacgctttgatataatataaaagctgtcgcatgaaacggcaacaacaaaaagaacattgataactgaacaatagacaacaaaccctgaaaattctttaaagagatttttcaagaacggacatcgaaagatgtcaaaccagaacagtaaacaggaacagaattgccaagcgattctgacccggatacaaacatttttaacgagagtttgatcctggctcaggatgaacgctggcggcgtgcttaacacatgcaagtcgaacgaagcactttaacctgattcttcggatgaaggtttttgtgactgagtggcggacgggtgagtaacgcgtgggtaacctgcctcatacagggggataacagttagaaatgactgctaataccgcataagaccacggagctgcatggctcagtgggaaaaactccggtggtatgagatggacccgcgtctgattaggtagttggtggggtaacggcctaccaagccaacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggctgtgtaagtctgaagtgaaagcccggggctcaaccccgggactgctttggaaactatgcagctagagtgtcggagaggtaagtggaattcccagtgtagcggtgaaatgcgtagatattgggaggaacaccagtggcgaaggcggcttactggacgatgactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgaccggcgtgtaatgacgccttttcttcggaacaccggtgacaggtggtgcatggttgtcgtcagctcgtgtcgtgagatgttgggttaagtcccgcaacgagcgcaacccttatcttcagtagccagcattttggatgggcactctggagagactgccagggataacctggaggaaggtggggatgacgtcaaatcatcatgccccttatgagcagggctacacacgtgctacaatggcgtaaacaaagggaagcaagcctgcgagggtaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctcctttctaaggaagctggataaaagtaggacgcgaaagcggctgaatcaatccaactaaaacggaagaagaagtaaggaaagttcgttgtctattgttgagttatcaaaactcagatatttctggtggcgatgcggtcaggggacacacccgttcccatctcgaacacgatggttaagacctgatcggccgatggtactgcactggagacggtgtgggagagcaggtggccgccagattataaaaaagaaaataagcagactgtgcttgatttaatatgaaactttggagaatcgctccaaagcgtcaagcgactaagtggtggttagctaccgcactagtctttcagcatagatacagacacagaaccgaaggggattctgcggtcaacccaatcagcagggcagtgctgttacgatagctggtttttaccagtgattaaagatcaaaagaaattttggtttttaatgactgataaacttcagtcagacatgtactttgaaaactgcatacaaaaataaatcaattctcaaatagagaaagacatccgaggtgatcatcaccgcaaggtaatgattaacttacatcttcgagaaaacgaagtaaaaaaacgacctgaaataccaacgcatgcaacgctatgcatgtgtaaccggatcccattcccgtgggagaagggagttggttatgctagaaagagcgcagggtggatgccttggcactaagagccgatgaaagacgtgataagctgcgaaaagcttcggggaggagcaaatatccgatgatccggagatatctgaatggggaaacccggctggacagactccagtcatccatacgccaatccataacgtatggaagggaacccggtgaactgaaacatctaagtagccggaggaagagaaaacaacaagtgattctgtgagtagcggcgagcgaaaacggaagagcccaaaccggaatgcgtgcattccggggttcggaccgcgtaattgatctgataagtttagcagaatggttttgggaaagccagccagagagggtgaaagccccgtaagcgaaagacgagtcagcaaggcgggatccagagtaccacgagacacgagaaaccttgtgggaatgagcggggaccaccccgtaaggctaaatactccttagtgaccgatagcgcatagtactgtgaaggaaaggtgaaaaggaccccgggaggggagtgaaagagaacctgaaaccctgtgtttacaagctgtggaacatctttatatgatgaaccgcgtactttttgtagaacggtccggcgagttacgccatctggcgaggttaagttcttaaggaatggagccgaagtgaaaacaagtcttaatagggcgttaagtcagatggagtagacccgaaaccgggtgatctatccatgtccaggatgaagttgccgtaaaaggcaatggaggtccgaacccacatccgttgaaaagggtggggatgaggtgtggataggggagaaattccaatcgaacccggagatagctggttctcctcgaaatagctttagggctagcctcatgagagtcttttggaggtagagcactgaattcccgcgggggcgtcaaagcttaccaaaggatatcaaactccgaatgccagtaagatgattcatgggagtcagactgcacgagataagttgggcagtcaaaagggaaagagcccagacctgcagctaaggtcccaaaatgtgtgttaagtggaaaaggatgtgggatttcaaagacaaccaggatgttggcttagaagcagccatacattaaaagagtgcgtaatagctcactggtcgagaggtcctgcgccgaaaatgtccggggctgaaacacactaccgaagctcaggaattaacgtagttaattggtagaggagcattcttaaagggaagaagcagtaccggaaggagctgtggacttttaagaagagagaatgccggaatgagtagcgagaggaaggtgagaatccttccggccgaatacccaaggtttccagagtaaagctgatctgctctgggtaagtcggggcctaaggtgaggtcgaaagacgtagccgatggacaacaggttgaaattcctgtactgcagtataacagaactgtggggacgcagagggagagcactagcgggaatggaatcccgcggcaagcgaggtaggagtagagttggcaaatccgctctataatccgaagacgtgatgcataccgaacaaaagtagggaaatgtgtgagccagctgccaagaaaagccgctattgtttgtactgtacccgtaccgtaaaccgacacaggtaggtgaggagagaatcctaaggccgacgggagaagcattgttaaggaactcggcaaaatgactccgtaacttcgggagaaggagtgccagtgagagctggccgcagagaattggcccaagcaactgtttagcaaaaacacaggtctatgcaaaaccgtaaggtgaagtatatgggctgacgcctgcccggtgctggaaggttaaggggagaggttagcgcaagcgaagctttgaacttaagccccagtaaacggcggccgtaactataacggtcctaaggtagcgaaattccttgtcgggtaagttccgacccgcacgaaaggcgtaatgatttgggcactgtctcaacaatgcacccggtgaaattgaaataccagtgaagatgctggttacctgcgccaggacggaaagaccccatggagctttactccagcttgatactgggattcgatattgtatgtacaggataggtgggaggcgaagaagcattgacgccagttgatgcggagccgctgttgggataccacccttgcagtattggatttctaaccagcagccgtgacccggctgggggacaatgtcaggtggggagtttgactggggcggtcgcctccgaaagggtatcggaggcgctcaaaggttccctcagaatggttggaaaccattcgaagagtgcaaaggcagaagggagcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgaagtaggtcccaagggttgggctgttcgcccattaaagcggtacgcgagctgggttcagaacgtcgtgagacagttcggtccctatccggcgtgggcgtaggatatttgagaggagctggccttagtacgagaggaccgggctggactgaccgctggtgtatctgttgttccgccaggagcatggcagagtagccaagtcaggaagggataaacgctgaaggcatctaagcgtgaagcccccctcaagatgagatatcccaacgtaagttgtaagaccccttgaagacgacaaggtagatagggcagaggtggaagtgcagtaatgcatggagctgactgttactaatcggtcgagggcataaccaagaaggtaggacagggtaaggaagaatggatggagtaaagatttaaatttgtatgtggttttcagagtacataaaaaatgaaaaaagcacttgcaaaatatatgtaaagtgtttataataataaaagtagtcctcgatagctcagcggtagagcattcggctgttaaccgaagggtcgttggttcgaacccaactcggggagttctaaaatctgtcagccaattacttgcagattttaattttgaaaaaaatcaatatctggctccgtggtcaagcggttaagacatcgccctttcacggcggtaacacgggttcgattcccgtcggagtcatctggcgccatagccaagtggtaaggcaaaggtctgcaacacctctatcaccagttcaaatctggttggcgcctctaggagaaatctggaaacaattgtttccagattttttggtatacaaatataatataccatatataaaaatgcggtatgtgaagaatgtgcttcctacatcaaaaaataacagaaaatatattgaaaatcagctttcgggagccattgagcagatggaagaatatatcagaaagtatccgatgtttcttgttatggattatgtgtaaaactatagattattataacaattaaaatattgtttcgtcatcttgaatatgctatacttgaattatgtttataggggcaaagctgttgaaaaactgtgacgcaaagccaaagggactaaggcggttacgctatgtcagccggttgcaataagaagatgcggataggttaatagagtaagtgaaaataagttattcggcttaaattttagtcacctgtataacgcaggtgacttttttgtttcataggaaattacattttctatgtagaaaagcttccggcagaatgcataggagatgagggaaatgaaaaaaggaaagaaattgaagcattctgcattttgctcattgtgacattgttgcttatttttgtcagaatactgtatcagccgggtacggagtcggaaaggggcgagttgtacaccttcagcaatggatggtatcagctggaagtctgcataggagaccggcttctctaccaatataaggataacagatttgaaaaaaacaggcagatgaaagggaaaatatgggcagatatttctttgctggagaaaatcgggcaggaagtgttatcaatcagctatgaaactaaaaagaatgccagactatatgtgtatgccccgatgatcggagagttttgttttatttttaggcagcatcttctaggatcatttttttcgatactgatgattttgggaatgactggtctcggtctcgtctcggtgattgtctttttatataccagacacagacaaattgtagaaaagaaatttttaaatgtagcactgtttttgattctatgcagtctgtggtgcatttttgattcagggatttatcagatgtatggaagtcagaacgcagcaggaacactgatatccttttatgcgtttatgacgatgcctgttcccatgctgttatttgtacaaaatacagtgagtgaaagtgtaagatggataccgcaggtctggatttttcttctttatgcaaatgctgttttacagggattcttgtattttctgtttaggattccttttatagacatgttatttatcacacatcttttattatttacgggggttgtgtctatgattcttcttttgtggaaagagtatcggaaaacgcaggagaaggaagtaaatctctgtctaaaggcatttggtgtattagggataagcggtgtaatcgcactggtactgtactgggtattatccatttactggtatgaatctattttccagtttggcattcttctttatattgctgttttgttttggggattgctttgtaaagtatccaacaacattcagttttgcctggaacaggagatttataggagaatgtccttggaagaccggatgacagatatgaaaaaccggaaatcatttgagatgtatcttgaagagatccaggagggtgcgattttacttgaaaatgtattattgttgtttgtgaaaattgcagaactgaagaagattaatgatatatctggaagacagatgggtgatgaaacggttatccgaacggcaagaagcatccagagtgcagaaaggagtgttctggaacagcaggcagacgatatgctttgttcaaataaataaaaccggcggaggataaatatgacttataatatagattttcttattgcggcaatggttatattgttgctggttttatggtattttctgggacagaaaagagcagaggatctgaataatcaggtattccttttctttgccatcatcggtattttagatgtggttgcggaacttgccagtaattattatatttcttttccaaatagtaattgtgaaattgctgcaatgcttgcaacaacgatcttttatctgcttcaggcattgctgccgtttacggtgatctgttatattcagacattacatgataataagatcatttcggcaaaaaagatgtttttatcaggtgtgccgacattcattctgatggggatgattctgacaaacccgttcacggaaaagctgttttattttgatataccggcaggctatatgaaaggtccatggtatatgctgatgtattacagtgcactttgtcatatgacagcagccttgatccttattgtcatatggcggaaaaaactgggctatcaaaaagtgaagagtctgctggaaatcctgttgatatccggtgcgggagtggtgatccagcttttatatcatccgcttcttacaacagggtttggtatgagtctgggaattctggtactatttattacgatcaacaatcctcatgcaaatatcgatacacttaccggattatataatcatctgtatctggccagaaaaagcaatgagctgatcagtgcgggaaaatcatttcacattattacggtgtatctttatcaattgaagcacattaataaaatcgcaggggtacagggcggtaattcaatcttaaagctgacagcaagaaaacttggtgagatgtgcgggaaaaaagcatttcgtacaacgggaaagagttttatgatacttactggttcacttgaagaatatgaatattatcttacgcagctgaagagaatgtttgatggaaacagtaagctgaatgtcaacaataaaattattacgatgcctgtgatcataagcgggatcatgaatgcgcagaaactcggagacagcgggcttattctagaatatgctgaatatctggaagccttatctgcgaaaaatggtctgacagaggtgatacaggatgattatcagacgatgaatggtttcctttataataaacgggtagaacagtatttgcataaggcgattacggaggatctgttcgagatatactatcagccggtttactctacacggaaaaaatgctttatcacactggaagcgctaagtcgccttcagcatccggagcttggctggatcgcaccagatgtatttattcagattgcagaaaaaaatcatatgatcgaacagatcacagatctacagtttagtcgtgtctgcagatttttaggagaaaaccgatacctgatgaggcatcttctgaatgtaaaagtgaacctgtcttctctggatctgatgagaaatgactgtagcagacattttatccggattatggatgcttataagattccacataactggatacagtttgaaatcacggaaacggttgcgactgaatgcaatgcgggtctaagaagagttgcggaggaatttacggacgctggcattggtttgtgtctggatgattttggttccggatatgcgaatctgaatacggtaatgaggcttccgttttctgtgatcaaggttgacagatctctgctttttgatatctgcagggatgagaaacgggcaattttctatgaaagtgttgtagaaacatttcataaaatgaattatcatattgtttccgaaggggtggaaacacaggaagaaatggaacagatcagcagctggggagtcgagatgattcagggctattatttttccaagccgcttcctgaaaaagagcttttggaattgctgaagaagcaggataatatagaaagataaaattaagagggaagggagatagtagatacacatggggacatccgattgcggaggcaattcatcaggcagacaaattaatgtatgaaaataaaagaatgtcataaagaggaggaaagaaaatgttacttattaaaaatgcaaaagtttatgcaccggagtatgttggaaaaaaggatcttttagtatgtgggggaaaaattgaatgtatggaagataagatcgaggattttccgatcgcatgtgaagttattgatgcagaggaaagaattcttacaccggggtttattgatcagcatgttcatgttaccggaggcggtggggaaggaagctttcatacccgtacaccggaacttcagctgtcagaactggtaaaaggcggaattacaacggttgtaggacttcttggaacggacggacttacaaggagtgttgaaaatctttacgcaaaagtacaggctttatgcgaagaaggagtaagtgcgtatatgcttaccggtgcatatggatatccaagtccgactattaccggagaggtagatcgggatattatgtttgttgaaaaagtacttggcgtgaaacttgccatttcagatcatcgggcaccgaatgtgacggaaagtgaactgatccaacttgcaagcaagaccagaacggcaggtatgttaagcggaaaacctggaatcgtggtgctgcatatgggagatgcagatgctggattatcgccggtgtttgaagctttggaaaagagtatgattccgatcaagattttccgtccgactcatgtgaatcgcagaaaaggtcttctggaagagggctatcagttgcttgaaaagggtggatacatcgatctcacctgtggcatcagtgaggacttttgtccgggcggatgcattttagaagcaaaagaaaagggaatcccgacagagcacattaccatcagctccgacggacacggaagctggtcaaaatacagagaagacggaagtctgttggaaatcggtgtttcctcagtagatgcgctgcgggaagaacttctgtatatggtacatgagcttgatatgaagctggaagatgcacttccatatatgacatcacatgtagcggaggcactgggattgcagggtaagaaagggacaatacaaaaaggagccgatgcagatctgcttttgtgggacaatgacctgaagcttgacagttatattgcaggtggaaaaatctttatgcaaaaagaaaaaatcatttgcaagggaacctatgaaaaataggaattgaataaagtacaacgttagcctgttaaaatattcccttgcggaaatgccggaaaagccttaaaataaaggaatcatgtgtatacagaaaggaatatgctttatggaaaaagggactatttttaaatttcataacgatctggatacagaccagatcatcgcatcccagtatctgttgctgccgaatcttgaggagatgaagagccacgcatttgaatctctggatccggattttgcacagaaggtaaaaccgggagatttcgtggtcggaggagagaactttggatgtggatcttccagagagcaggctccgggtgtgttaaaagcgttaggtgtaaaagctgttatcgcaaaatcatttgcaagaattttttatagaaatgctatcaatatcggacttcctgctattgtctgtaaagaccttccggatgaagtaaagaccggagatcagatggagcttcatatgctggaaggaaccgctgaggcaaatggaaaggtttattcctgcacaaaactgccggaatatatgcagaatattttgaatcagggcggacttattgcgtctctgaaccgtgaggaggaatagacgatgggaatgacaattgctgaaaagatcattgcagcggcagccggtgtggaaagcgtaaagccgggtgacatccatacagtagaactggatcgtctgatgagtaatgacggaactacacatcttaccgttgatatgtataataataaattaaaaaatccacatattgcagatacaggcaagctggtatttatcgtagatcataacgtaccgtctgactgtccaaagacagccgcatcccagaagaagatgcgtgattttgcaaaggcaaatcacattgatttctgggaagggaaaggtgtatgccaccagattatgatggaaaattatgttcgtccgggagaactgatctttggtgcagacagccatacctgttcttacggtgcacttggtgcattcggaaccggtgttggatgtacagacttcctttacggtatggtaacaggaacttcctgggtaatggtaccggagactgtgaaattcaacttggttggaaagctgccggaaggtgtatatgcgagagatctgatccttaccatcatcggtgaagtcggggccaacggatgtaactatcaggtgatggaatttaccggagagggcgcgaagactctgacaatcagtgaccgtatcgcactttgcaatatggcagtagaagccggagctaagaccggtatttttgaagttgatgatgtggcaatggaatatttaaaagagcatggacgcgagccaaaggctgtatatcacagcgatccggatgcgcattatgtaagagaatatacatttgacttatccaaggtagagccggttgttgcaaaaccggattttgtagacaatcttgcgccggcaaaagacgtgcgcggtatcaagattgatgaggcattccttggatcctgcaacaacggacgtatcgaagatctccgtgtaggcgcacaggttatcaaaggaaagaaagtatctgaaaaagtaagattccttgttgttccggcaagtcagactatttacagacaggctctggaagaaggactgatcgacatcttcatggatgcaggtgcgatcgtgatgaacccgaactgtagtgtatgctggggaagctgccagggcgtaatcggtgaaaatgaagtcctgatcagtacaggaacccgcaactttaagggacgtgcaggacatccgagttccaaggtatatcttggatcggctgcaaccgttacagcatctgccattgccggagaaattgcactggcaagtgatgtgtaagagacgaaattacgtttgacgaggtgacataagatggataaatttacaggacgtgtatgggttcttggagatgacattgataccgatatcatcattccaactgaataccttgcactcaagacaatcgatgatatgaagcagtatggcttttctcctcttcgtccggaacttgccggacagatccagaagggggatatcattgtagcaggaaagaactttggttgcggttcgtcaagagaacaggcaccggagatcatcaaggcaatgggtgtgcagtgtgtgatcgccaaatcatttgcaaggatctttttccgtaattcgatcaacaacggactccttctgattgaacagccggatctttatgatgatatgaaagagggcgacgagatcacggtagtgatgaatgagcatgtggattataatggcaaggaatatccgattgcttctctgccggagaatctgatgagcattattcaggctggcggtctggtaaaagccatgcgcaagctgaatggactggattaaccggaaaggagaagaaaatgggcgagacgattattgaaaaaattatcagacacaatataggaaaagctgtaaagccgggagacattgtgacggttaacgttgaccgcgtgatgatccatgatattttcatcccctttgtggcagaaaaatttgaagaaatgggatttacgaaactgcatgatccggacaaggttgttctgatctatgatcatctggttccggcaagtcagcaggatgataccagacattttcgtaccggagatgcatttgcagataaatacggacttacacatgtacacagaagtgacggaatctgccatcagctgatgacagaggctggctatgttaaaccgggtgatatcgcattcggaaccgacagccataccacaacttatggttgtgttggagcattttcatccggtatcggttataccgagatggcaagtatccttggaaccggaacgatgtggatcaaggtaccggagacgatcaaagttgtgatcgatggtgaacttccggaaaatgtcatgtcaaaggatatcatcttacgactgatcggtgatttgagagcagacggtgctacttacagagcattggaatttgctggaagcaccattgaaaatatgacagttgcaagccgtatgacaatggcaaacatggcaatcgaagcaggagcaaaatgcgcacttttcacaccggatgagaaaactgccgagtattgcaatattgaattaaatgattatcagaagagtctggttggtgatccggatgcaacttatatgagaacgatcacttataaagcagaggactttgtaccggttatggcccttccgtcacaggttgacaaaatcagaaatgtatccgaggtagaaggaaccgagatcgatcaggtatttatcggctcttgcacaaacggacgtctggaggatcttcaggcagcagcagaagtgttaaagggcaaaaaagttgcggattttgtaaaactgatcgtgactccggcgagccgtaagatctacaaacaggcagcagatatgggaatccttacgactttatctgaggcaggtgcgatcattacccatccgggttgcggactttgctgtggacgtaccggaggaattctgtcagacggagaacgtgtggttgcaaccaacaaccgtaacttccttggacgtatgggaacttctaaggtcgagatttatctggcatctccgaaaacagcggcaagctgcgcggtggcaggaaagattgtaagtccaaagtagaggagttcactatgaaaaaaattggatttatcggtgttggcatcatgggaaaatccatggtgcgcaaccttatgaaaacaggatatgaactgcatatttacgcaagaacaaaagcgaaagtcgatgatgtgatcagcgagggtgcaattttccatgaatctatcaaagaatgtgtacctggatgtgatgcagtgatcaccatcgttggttttccgagagatgtggaagaggtttacttcgatgaaggtggtattctggaaaatgcagatccgggaacctatctgatcgatatgacaactacaagcccgatgcttgcagaaaagatttcaaaagagggcacagaaaaaggattccatgtgctggatgcgcctgtaacaggtggggataccggagcaaaaaacgctacattatccatccttgtcggcggcgagaaagaagattatgaagcttgtatggagcttttcaaagcaatgggaacaaacatcaattatcagggaaaagccggatgtggacagcatgcaaagcttgctaatcagattatgatcgccggtgccttaagtggtgtatgtgaggccttttcctatgcgcaggccaaaggactggatctgaatgtcctttttgattcggtctctaccggggcagcaggaagcaaacagttggatgctttcggaccaaagatcattgctggagattatgcaccgggattctttatgaagcatttcatcaaggatatgaagcttgcgctgactgaggcgaatatgagcggactgagtcttgaggtgctgagtctggtactgtcaaattatgaagagttggcacaggaagggcttggagatcttgggacacaggcgctgatcaagtattatgatatgcaggatgtagaagaataatcgtatgtgatttagggagctgttttgcagctccctgatattttgtgtttcataaacagtaacgagaaaacccgctgatctttcgaccagcgggttttcttgtgcttttatttaatttctaaaggaatgagagtaaagtgcggcaatcggggtaacccgattgcgcttactttatgaggggggagatagttgtttatcaactatctgactcttagtatacagataaattgtgttcaaaatatgtctatatcataaaagaaaaagaaaatttcttaaggaaaaatgaactatcgattaaggaatattgattagagtacaataaaaaaatcattgcgaaagtactttcaaatgtaatcagattctttttacatcgttgcaactgcggtagtttaatggtatactggacatattgcaaaagtagaaaatggcagcagaagctgtcggcaatgtttacaaggctcattggggttatgtgaaatatataagagagtaatacggaggaacagaacagatggatttggtaacagtaagagaattatacagaaacagagaggaatatctggataaagaagtgaccatcgggggatgggtgcgcagtatccgtgattctaagacatttggatttatcgttgtaaatgatggatctttctttgaaaaccttcaggtagtatatcatgataatatggagaactttggcgagatttccaagctgaatgttggtgcggcaatcattgtaaaaggaacacttgtcgcaacaccacaggcaaagcagccatttgagatccaggcaacagaagttgttgtagaaggtacctctgcaccggattatccgcttcagaaaaaacgtcacagctttgaatatttaagaagtattgcacatcttcgtccaagaaccaatactttccaggcagtgttcagagtacgctcactgactgcttacgcaatccacaaattcttccaggaaagaggattcgtatatgtacatacaccgctgatcacaggaagtgactgcgagggtgcaggagaaatgttccaggtaacaacactggatatgaacaatgtgccgaaaaatgcagacggaactgttgattattccaaagatttctttggaaaagagacaaaccttaccgtaagcggacagctgaacggtgaaacttatgcacaggcattccgcaacatttacacattcggaccgacattccgtgcggagaattccaacaccacacgtcatgccgccgagttctggatgatcgagccggaaatcgcatttgcagatctggaagatgacatgatccttgcagaaaacatgctgaaatatgttatccgctacgtgatggaaaacgctccggaagagatgaatttcttcaattctttcgtagacaaaggactgatcgaccgtctgaacaacgttgtaaattctgatttcgcaagagttacttacacagaagcaatcgaaatccttgaaaaacacaatgacaaatttgaatacaaagtatcatggggagcagatctgcagacagagcatgaacgttatctgacagaagagatctacaaacgtccggtattcgttaccgattatccgaaggagatcaaagctttttacatgaagatgaatgatgataacaagaccgtagcagcagttgactgtctggttcctggaatcggtgagatcatcggaggaagccagagagaggacgactacgataagcttgttgcaagaatgaaagagcttggacttaaggaagaagattacggattctatctggatctgagaaagtacggatctacaagacatgcaggattcggacttggatttgagagatgcatcatgtatcttacaggaatgtccaacattcgtgacgtaattccgttcccaagaactgtgaataactgcgaactgtaaaaaagaagaatgaagaaaaaggggaccgggaactgcatcaaaagggtgtgttttccggtctgctgttttacacgcaaatctttctatatacggaaaggaaaagtgaaatatgaatattttagttgtagatgatgaaaaagaaattgcggatgtcgtagaattatatctgcaaaatgaataccatgttttgaaattttacacagggcaggaagcattggaatgtattgagaagacaaatgtggatctggcgatcctggatgtgatgctgccggatattgacggtttcacgattctgagaaagatccgtgagaaatacacatttccggtgattatgttgaccgcgaagacggagtatcgggacaagatcaccgggcttacgatgggggctgatgactatattccgaaaccattcaacccgctggagctggtagcgagagtgaaagcgcagatgcgcagatacacgcagtacaacgatggtaagaaaagtgattctgagaatatcattgattttgcaggaatcttgttaaataaagaatcccatgaatgcatctataatgagcagtctcttccgctgacaccgacggaatttgagattctgtggattctttgtgagaatcgcggaaaggtgatcagctcacaaagattatttgaagaggtctggcatgaagagtatctgaagaacagcaacaatacggtgatggtacatatccggcatctgcgtgagaaattgagtaaaccgactggaaaatcagatcttatcaagactgtctggggagtgggatacaaaattgaagaataattacagaaaattaaaactgagcatattgcttcagacggtttttattacggccctgacggtgctggttggcagatttattctggagtattttatcgatggtatttataatgacagctttgccaatggctttttgcgaatattggaagcttttcatgtgagtgaagagaccgcaacatctttgtattggcagtggatcggcaataataaagtgttctttatgatcctcggttttttacttttattttcgttgtttttttatgtggcactttcaaaaatgacgcgttatctggaacaggtagaagatgggattgaaaatattatttctgcgtctgaccagccaatccgactgattacggagttaaaaccaatcgaggatcgtctcaatgagattaaagagacattaaggagccaggaggaagaggcagaaaagcttgagcagaggaaaaatgatgtcctgctttttatggcacatgatttaaaaacaccgcttacttctgtggtagcgtacctgagtatgctggattctcatccggagatgccggcagaggagcgcgccaaatatacgcagatatctctggagaaggcgaatcgactgggggatcttttgaaagagttttttgaaagtataaagttgaatctgcaggatattgaactggataaggtggatattgatctgaccatgatgctggaacagattgcagacgaactctatggggtacttcaggagaagatgctgacctgcaaggtggaagcagaggaagagatcctgatcgagggagatccggataagcttgccagggtttttgataatattctgcgaaatgccatagcatactgccgggagaaaagtgtgcttctgatccaggccgccaaggaggagaaccaggtaagaatctgttttgaaaatgaaggagatacgatacctgaagagagcctgaagaggatctttgataaattttatcgcgcggatgcggcgagatccagcagtaccggaggagcgggactggggcttgccattgcaaaagagattgtagagctgcacaagggacagatcactgccgagagcagtgggggaaagacacgttttatcgtgacacttccccttaaaggaggagtagaaagtaatgaaattcatacacacagcggacattcatctgggggcagagccggacgcaggaagttcttacaccgcaaagcggccggaagaactgtggaatagctttgagcgtcttttaaatatctgtgaagaagaacagacagatattcttctgatcgcaggggatctgtttcacagacagccgcttttaagagagctgaaggaactggattatttattttccagactgacacatacacaggtcgtgctgatggcgggcaaccatgattacctgaaaagtacgtcctattaccggaattataaatggcagggaccggtgcacatgtttttgtctcagaaacctgcctgtatggaatttaaagagcttggagtccgcatatacggactcagctatgaggaacgggagatcacagaaccgctttatgagaaaatccttccggaaaaaagaggaatagcctccatccttctggcccatggcggcgatgaaaagcatatcccgttccgaaagaacgaattactgaagctgggatatgattatattgctcttgggcacattcatcttccggcagagcttgcaaaggaccggatgtattacgcaggatccctggagcctacagataaaaatgacaccgggaagcatggttatatcaaaggggagattaaaaatggaagaacccggacggaatttattccttttgcatccagagaatatgtgcatatggaagtagaagcaggaagagagatgaccggacgggaaatgaaagaaaaaatagcccttgccatacgggaaagaggtatacagaacatttataaaatcattctgcggggatttcgggatccggatatgatctatgataccgaccggatggattcctatggaaatattgtcgaaatcctggatgaaacaaagccggcatatgattatgaaaagttgaaaaaacaaaatacaggaaatcttctgggctggtacatagaaagttttgcagaagcaaaggatgacagtgtggagtcaatcgcattggctgagggagtacaggccatgctggaggcaaaggggagcaaattatgaagataacagaactgatcctgaagaatttcggtaagttcacgaataagcagatcctgctttcggatgggatcaatattatttacggagaaaacgaatcgggaaaaacaacgctgcatacctttctgaagggaatgctttttggaatggaaagaaagcgcgggcgtgccgccgcaacagatacattccgtacctatgagccttgggagaatccaaacttttacgcaggaatcctgcggtttacctgcggtgaccggagatttcgcctggaacggaatttcgatcggtatgcgaaaggcggctctctgatttgtgaagatgatggagaagaattgtcacttgagcatggggatctggaaattctgttaggtggtatgacagaaagtgactatgaaaatacagtttcgataggacagctccgggtacagaccggagaaatactggcggcggagctgaagaattatgcggcaaattattatgcaaccgggaacagcgagattgacctcgaaggggcgcttgcccttttaaaagagcggaagaaagagctggaaaaagaagaacgtgaaaagaggcagctgatcagcgaaaagaaagagcgggcagagatggaggcatcctatgtctggcgggatctgcatcagttagaaaatgaagcggaacagctgaaaagaagctgtgaagagaaacgcagagaatgggaaagctgggtaaatgaagataaaaagcggaagaaacgggaagaggcagcaggatattttgctgggtggaggattcatccactggaggcagtgagtatgctgggggcattttttgtgacttttctgctttttcataagccgtggaattttcttgtggcaatcgtggtggcactggctgaaggactgtatgtctggaattgtctgaaagatggaaagaagaaaaagaaagccagattacaggagataaaagaacagggcatttctctcaaggcagattatgagaggcagaaaggaaagcttgcaaaagtacaggaaacctatcatgaaaaagaagtgttgtatgaaaatctgcaggaacgagtcggcgagttcgatgagatgaacagtgaagagatagagcgattaaaaaacaagcagggtgttgaacttgctatggaacagctgaccagacttgccgcacagatgcagagccggacaagcgatcttatgaatacagaagtatctgcaatcatggatgccatcacagatggaaaatataacagactctgggtagatgaaaatctgtatgtgcaacttatgagtaatgggaaaaagatatccatggatcaggtaagccggggaacgctggaacagatttattttgcaatccggatggccgcaacaaaaattctccacgaggaagaatgtccggtaatcctggatgatgtattcggctattatgacgacagtagacttgcgcagacccttcgctggctgaaagacagtaagcggcaggtaattatattcagctgtcagaagcgggagatggaaatgctggaaaagatgggatgtgaatatcataaggtgatgttgtaaagacaaggaggaagattttatgattcggcttcaggatattgcagaaatggcaggcgtcagccgtactacggtatctaatgttataaatggcaataccaaaagagtttcccagaaaacgattgataaaatcacgactattcttaaagaacagaactatgttccgcatatgggttccgtgatgctttccggccatggttccagaattataggtgtagtactcggattttcttatgcccatggtatgcagtcacttcaggatccatttgtgggagaactgatcggaacgattcagatggaaacggaagaaaatggatattatgttatgcttattggcggtgaaagtattcagaatgtagtggatattgcctcaaaatggaatgtagagggattgcttatccttggctacaatgaagaacagtatcgcagtctttcgcgcagattaaacaagaaaatgattctgatcgatgcttatccggaaggtgcttatacgttccagaatgtcggtatagatgattattcgggagggtatcagatcggagaatacctgtattcctgtggatataagaaagcattgtttgttgcggaaacggagagagacagtgattactatcggtggatgggattcaaacaggcgatggaaaaatcggggggattctgcagtcgttcccgatatataattattccgggtgaaaaaagattgcgtctcagaaaatacagagagcttctcccacgttttttagaagcaaaagcacttgcgttttcctcagattataatgcgatagaagcgataaatttcttttttgatgaaggcatcatggtcccgaatcagatttctgttacaggatatgatgacagtgtctacgcaagtatggttcgaccgaaactgacaacggttcatcaggatgttccgcaaaaggcgcatgtggcgctgaaacgtctgctgaaattaattcagggagagacattggacgaattaaatataaaaaatccagtctatctggtaaagagggattctgtcagggaatgacaggatccttttttcaactttgcatgtatacaggtaagccggtggaatggtctggttgtttttgtgcagactgtataaaagcaggaaataaactttgttgtcttttatagtttcgcgagaaacctcttgattttgctaagatgtatggggtatcatgaatagtgttgttacaggagcggttaaataatactaaacaattataaacgaggagatttggcatggagaaaaaatggtggaaagaaagtgtagtatatcagatatatccaaagagttttaaagacagtaacggtgatggtgtgggagatatcagaggaatcatacagaaactggattaccttaaagaacttggggtaaatgtattgtggatttctccgatgctggaatcacctcaagacgataatggttacgatatttctgattaccgcagaatttatgaagaatatggaacgatggaggattacgaggaattgttgtgtgaagcacacaaaagatccatcaggattctgatggatctcgtagtcaaccatacttcagatgaacataactggtttattgaaagccgtaaatcaaaagataatccatatcgtgattattatatctggaaagatccggtaaacggaaaagaacctaataactggggcggagcatttggcggttctgcatgggaatatgatccgcaaactcagatgtattatctgcatctgttttcaaaaaaacagccggatctcaattgggaaaatgaaaaagtacgccaggaagtttatgacatgatgaaattctggtgtgaaaaaggaatcgatggcttccgaatggatgttatcagtatgatttccaaagatcagagatttccggacggagaaatgaataacggtctttatggagactttggaccatattgtgtacatggtccaagggtccacgaattccttcaggaaatgaatcaaaaagttctttcaaaatatgatatcatgacagtcggtgagaccgcaggagtcacaatagaagaagcacagaaatatgcgggtgatgaccgaaatgaattgaacatggtattccaattcgagcatgtggagagtggatgcggagattatggaaagtggacgactgcaaaatatgacttcaaagagttcaaaaatattatgatcaaatggcaggaagaacttcagggtaaggcgtggaacagtttgtttttaggtaatcatgatcaaccgagaagtgtcagccgttttggaaatgacaatccggtatacagagaaacctccgcaaaaatgctggcgacctgtattcatatgatgcagggaacgccatatgtatatcagggtgaagagcttggtatgacaaacatttactttgacaaactggaagattaccgtgatattgaaagtattaattactttgaagagtttacggaatcaggtcttatgactccggaacacatgatgaaatgtctgatgctgagaagccgtgacaatgcgagaactccgatgcagtgggacgacagtaaacaggctggattcacagagggcgagccgtggatcaaagtgaatccgaactacaagaagatcaatgcagcacagcagcttgaagatccggattctgttttccactactatcagaaactgatccgattgcgtaaagaaaaagacattattgtttatggtgaatttgaacctctttaccgtgaggatgaacagatttttgcgtacacaagaaaacaggatcaggaaaagcttctgactgtctgcaacttcagcgataagaatgcagaagtagaagtgccggaagaatttaaaggcgcagagtgtctgatcacaaaccttggaagaaaagaatttgaaggaaaaattgttctgaatccatatgaagcatttgtactatattataaacactaggtgataaagaaatgattagaaaatatagatatggaactccgtttgatacggaggcactgactgaaaagattgaaacaactaagggcgttctcccgtatggagaagtcagtcaggaggaaggatttgtttttacttatatcatggatgaagatgatattgtctatggtctgggtgaagccaatcgtggaatcaacaagagagggtactgttatatcagtaattgtacagatgatccggtacacacagaggacaagcgttctctgtacggagcccacaacttcattgttgtgagcggaaagaggacgtttggattgtttttcgactatccctcaaaactgacctttgatattggatatgacagagaggatacccttaaggtatcttgcgaaaatgctgacttggatatctacgtgcttgaaggtgagaatgcttatgatatcgtaaaacagtttcgccacgtaatcggacgcagctatatcccaccgaagtttgcctttggtttcggacagagccgctggggttatacgacgaaagaagatttccgtactgtcgcaaaaggatatcgggaaaatcatattccgatcgacatgatttatatggatattgactatatgcagtcattcaaagatttcacagtgagtgaagagaatttcccggattttccggaatttgtacaagaaatgaatgaccagagtattcgcctgattccgattattgatgccggtgtcaaggttgagccgggatatgagatttacgaggaaggtgtcaaaaacaactatttctgcaagagagaagacggaagtgattttgttgcagctgtatggccgggagatacccattttccggatatgctgaatccggaagccagaaaatggttcggagacaaatatcgttttctgatcgaacagggaatagaaggtttctggaatgatatgaacgagcctgcgatcttttattcttccgaaggccttgcagaggcaagagaacttgccggagagtttgcaaaggataccgaaggcaagatccatccttgggaaatgcaggacaagatgctcagtattgcgaatgacccggaagactataaaagattttatcacaatgtggaaggcaaaaagatccgtcatgacaaagtacataatctttttggctataatatgacaagagcggccggagaagcgtttgaacgcattgacccggaaaaacgttttctgatgttttccagatcttcttacatcggaatgcatcgttatggaggaatctggaccggagataataaatcttggtggtcacatatccttcttaacctgaagatgctgccgtctctgaacatgtgtggtttcctgtatacaggtgctgaccttggaggttttggtgctgatacaacaagagaattgctgcttcgttttctcgcacttggtgtatttacaccactgatgcgtaatcattcggcgacgggaacaagagagcaggagtgttatcaattcgaaaatatcgaggatttccgtgctgtcattaacactagatatcgtcttgtgccgtatctgtacagcgagtacatgaaagctgcgctgagtgatgacatgtattttaagccgttagggtttgtttatccggatgacaagagagcaatccgagtagaggatcagctgatgctcggaaacgagatcatgattgctccggtttacgagcagaacgcaagaggccgttatgtttatctgccggaagaaatgaaatttgtcaagttcctgccggatggaagcatttcggaagagattctcgcgaaaggtatccattatgtagatgtggcatcaaatgaagtaccgcttttcattcgaaatggtaaatgtatcccggttgcagaagcggcagagtgtgtgaaagatattgataccggacatctgcagcttatcggatatgagaacggcagttataccatgtatgaggatgatgggatccgcaaagattacgataaaaaagagaattaccgagtattcacaaattagcgtttaagagtaaaaaaatactgcttagatatcaaaatgatattacgaaatcaataacgggaaaatgtaatttgatgtgaattacattctcccgtttgattaccttggtatgcaaaaaaagctaccagtggaggttctctttatattaaaaatcatataaccatttattctcaagccgcctgagtatccggctatcgtcatctgaaagtggtgtaaaagcatgcgcttttttgcgaactggttcgtccggcagtttacacgcaccggagcagtgcgcttcaaaatcaaggcagttataaacacgtgcgccgcagaatgcacaggtgcggatggaatagacaaaccctttatagtcaggattataaaaatgctggtataaatctttatcataggagtgcatcccattccggcggacatcctgacaccattccgaaaaatcctgtgcagcataataagcggcggaagaagaaagattgaagaactgtccgacttcatttacagatttcagatgagcataatacatggcaatgcgcggagccagaatattacttgcaaaataattggcttcatcttcattggaaggaaggtcatttctgtgtcttaaaagatgatgtccaagttcatgcatcagcgaaaaacgaatccggttggctgatttctggctgttgtaagcaattaagttcagactgtttatacaaaatgcatcctgagaataggaaatacatagattgtagagctccggcttcttcttttggagctcaagataggaataaacacgaaaaccatactgcttcaaaatagcaaagcagtcaattggaaaggaatggatattgcaggtaatcagcgcattagctgccactttacgaatctggttacaatccaaagcaaagcctcctataagtcgatttcagataacagctgaatgagtttcatcttctgtgtcgcagaaaaaccatgactgccacgggcaatcatctgttcaatatcttcatatgatggctctgtgttatcggatgttactgtaactgaagagccgagaagataattcatatctacgttgaaaagcttcgcaatcttttcaagtgtctcgagatctggttcgcggttccctgtttcatacatactgacagcgcttcgggaaatgtcgagcagatccgccatctgtccctgcgtgtaatgattctgcattcttaaattcttaaatatattgtgaaaatcacccattttgttacctccatatatgactataatagcacgaaatgtgacaaaagtaaaatgatatatgacacgttttgtgaataaaaggattgacacatgacttctgtggctgtataacaaaagtgaggacacaaaacgtgacaaaaatataaaatcgacacagaatgtgaggtaatatggatgagaagaataagagtgagaaatatttcatggaaagattatgggatttctgtacagacacaaagagaactcaaagaattttgttttttatacgatgagaaaaagaaacgggggaaccgacaggatttgacagactgcaaaatgatcgaagaagcggcaagggaaagcagtgaagaactggcaccgtatcttttgaaaagtgttacggatgatctaagctatgagtatctggaatttgatgatacgctgggacgtattccggttggaaagacagatttttatggatacagaagaaaattctatgattgtcttttgaaaaaaaggatataaaaagtggggacaaatcggggacagcaagaacacacgttcgatatacaataacatcgaacgatacagatacaggacagagaaagatatctgatacgcgcgctttctgactgtgatgttattgttcagatacaaatcagaacagatcagaaggagaagattatgacagaaaaagtattacaggaaattacagaaaaacgagaccggtatacaaagcatttcatgctgcctgaaaaaggaactgccgcagcggtctatccggaaccggttcattatgagacggaaagtggatgggaagaaattgacaaccgactggaagcagtatcaaaggatggaaaagagtgttaccagaataaggcatctgacttacaggtatgttttgcaaagcagaccggagagaatacgcttgtaagcatggaaaaagatggaaaaaaagtttcatggacaatggaagaaaatgtggtatcagcaagaagcgcaaggcaggcaagaacaggaaaaagcagtttcaggattttaactgaagaggaattcccgaaaggaccagaagaactctacgaggagacatggagaaaggatattccggaggatgagccgacagagggttcaggtgacgagacgggggatgaagttaccatccttccaccggcttcagaagacactccggcagacggaggcagtaaagatatgccggaagtcaaagagatccagcagaagatgggtgtaaagcatctgacaagtgaaggaatgtatgaagaaattcttccgggcgtggatgtacattataccctgcagagccagcgtctgaaagaaaatatccgtctgaaaacggcacaggctgcagagcaggagctgatcttccatcttagatatacagacatggaaatgaagaaggaagaagacggcagtctgggactttacagtgaggatcagagagtcttctggtttgacaagccatatatgtatgatggaaaaggatgcgtgtcacaggaagtggaactgcttatagaagcagaagaaggaggatgcaaagttactgtcaaagcagaaaaagaatggctgcttgccgatgacagaagttatccgattattatcgatccgatgacagaaaccagtaaaacaaaaaccaatatcgaggatacctacatttttacaggcggaacggattcttcggctgacccgagtagtgtttatgcatatggctcttttgtggcagggaagtcaactgcacttggaaactgcaggtcattgctccgattccgaaatctgccggacatcggaaaaggttctatcctgtatgcagcgaccatgtatctctggcagtatgagtattccagttatggaatcgcaaaacttccgcttgttgcaaatgagatcctgaataactggacagaaaaggatgtgcgctggcacaatcagccatctgtatcaggaaatgtactggattataaagaagtgaaacaggtacagaacggcaatacgattatgatcacgccgatcgggtttgacgtgactcgactggtaagacagtggtacaatacgggaaataattatggaatcatgctgcgcggtatgtatgaaaatgaaagcgatcttacaaagacagcgtttgccagattttatgcatcggattatccaaagatttcaacagatcagtttccgagcggagtcttttattatcgaaatgtaaacggactggaggattatcagagctaccatgagcagtctgcaggacgtgcgggaaatggacataccaatgactttaccggcaatcaggtatggatccatgaggatgcagtgacaaccggcggagccatgcaggcagagatcagtcatgtttataattccagcgaagccggaacgaatctcggacagggatacggatggagactgagctgtgtgcagcgtctggacacaaccggaatcaaagaatatccttatgtatacacagatgaagacggcacaaagcattatttctataaagacacaaatgatggcaataagttaaaggatgaagacggacttggacttgtgattacggtagaatccgggtatgacgacagctatgcgagaaccatggaaacaaaagacagggtacggtactgctttggaaaagacggttatctgagatttgtcagagatctggatgaaaatcagatcaaatatgtatatcagaccatttccggaaaacaggtgatcagctatgtggaggattccagtggagcaagactggagatccagtatgagacagcaggaaatacggtacgtgtatccgcagtaaaagatatggcaggccgccttacaaagtatgcatatgacagtgcaggcaatctgacatccattacttatccggatggaaggacaagcagcttcggatatgatgcaagccaccgtttaaccagtgtgacgaacccggatggatatggtcttaagtatgagtataagaacgacttccgtgtaccaagggttagccggatcgcggaatatggttccggcaataaagcaggacaggagatgaaagtatcctatgagaatgggaatactactgtatttgagaccccgggactggacggagagattgcacagaccggagataaccggaaaatcacctatcatttcgacaacatggggcgcccgaccgatgttatggatcaggatggctgtgcgaacaattatacttattacacatccggaagcaagaaccataagctggacaaagaaggaaaggttcagaagacagtctgtcatttgctgaagaatccattatttgacagtgcttacggggatggaaactggtaccagaaaaatctgacgaacggaaccagaagcagtattgcaaaagcggagggatatgcaggaactaaaagtgcaaaactgaccaaaacaggagcagaatctgaaaaaggaatctgtcaggatgtaacgcttgagacgggaacttataccttttccgcatatctgaaaacagagaatgccgaaaacagcagggctggtctaatgatcctcatggcggatggaagcagaacagaagaagcttctgtaatctccggaacgacagatccggaaatggagaacggatgggaacgccatcagctgcagtttaccttagcggcagcaggaagtgttacggtatgtgccggtatcactgagggaacaggaaccctctatgtcagcggagcgcagctggaaacaggaaacgctgcaaacaagctgaacctgatcacaaatccgggattcgaactgggcagcacaagtcagccggactgctggaattatgcaggagatgtaaccggatccagagttgccggtgtgacgggaaaaggaaggtgcgcaacgatctccggacgatgggacaagagcttatattgcagccagacggtccatgtcagtgggaaaaaagatgaagtctacagtgtgagcagctgggtaaaaggatgcggtattccgggaaagaagttctcattgtcagtaaaagtaaccggcacatccggaaaagaaaaatggcatcattttaactgcaatccgaacattcttgactggcagtttgtcagcggcgtattccgtaccgaggaggcttataaagagatccaggtatatctgtattacgataaccagatgaataaggtgtactatgatggcgtgcagctgatacgcgatgacggggaaagctatgtatatgatggagaaggcaacctgtcgggcgcaaaggatgcagcagagaaatccggcttcagttacaacaaacgaggaaatctcacccggcttggagaaatagacgggacatcttttgagtacggttatgatgacaaaaatcatctcaaactggctgccaattcagaaggtgtcagatattcttttgaatacaatacaaagagagtcccggtaacagagatcacagaaggagagctgtattaccttcgggaaaagagctccggcaactatatggatgtgcgggatggaaggacatcctcctggacaaccgttcagctgtttgcctttaacggtacggtatctcagagatggagaattaccaaggcagaagaaggatactggaatctggaaccgcagaatgcgccggacatgcggttagatctgaaagatgcatcgacagcagacggagctgcaatccagatctttaccgataatggaaccgatgcccagaaatggaggatgcagaagaacagtgacggcacctggaaaatcctgaataaactgacggggacacagaaatgcattgcaaacgaaaagaagagtacggcatccggagaagcactgaaaaatataacggcatccgacagccatggaggtcagagctggtatctcgaaaaggtggcagacgaagggcagccggtccatatgcgtgtagaaggcggcagacatctgggggcagttacttcagagagaatctattatatccgtgaaaaaatatccggaaactatctggacgtacagaatggtggaaccgattccggaacagtcattcaactgttcccgttcaatggaaccaaggcacagcagtggaaagtgactgcctgcgatgacggatactttaaactacagccgcagaatgccccggcaatgtgtctggatgtgaaaaatgcaaatacagcagatggaaccacaatccagattttcacagacaatggaaccgatgcgcagagatggaagcttcagccaaagagtgacggaagttaccagatcagtgaaaaattcacatcagacaaaaaaggtatgaccaatgagaaaaagagttccgagtccagaactccggtgacaagctgtacattggcagatgataatccgggacagtgctggtactttgaaccggcagatgaaggaaccgtctcagatgttccggcagacgggctggtagtaagtgtacgagtgcgccattccggtcagtatatagatgtccataattatggaacagtggaaggcaaccgggtaaatcagtattataagaactgtaaaacgaatcagatgttccgactcaaaaagagagaagagaagtattatacgatggagccgcttcacgcacctggaatggttctggcaagagccacttccgcagacaccctgatcctccagaaatattcagcaggtgcggcaaaccagctgtttggttttacggagatcgaagaaggaaaaggaaccggatatcttgtaatctgtaaagcaggagaaaaagaactgacggtaaaaggtcagacctatacagcgggaacagaactggtattttctgaccattccggcacaccgacccataaatggtggatcctggaaagctacagtgaccgcatggaatcttcgatggaatatacttccgatggaagacaggtcaaaaagatcacggatggaagaggatacagcaatacctatgcctatgatgaaaagaatcgtttgctgacttcggttacggatgcggaaggatatacgaccacctatgattatgacaaaaatacagatcagctgatccgtgtaaagaagaatgcagatggaaaagattatgtgcttcagtacacctacgaacaggataagatcaaaacgatcacacgaaatggcgtcacttatggttatgcttatgatgcatatggaaaccagaccggtgttaccttgaatggaaagatcctgaaggaagtgacctaccgaaataaaaacgggctggaagaccggctgacttttgcaacaggagaaacgctccgcaatgtctacgatgcggaagaacgcctgaccgggcagtatctgatccataaagacggtacagaagaaaagcttttcaccaatgtgtatgatcattatggaaatattgcagtccacaaagatgagcggacacagctggaaacccgctatcagtatgacctgatcggaagacttctggaaagcagatccactgatggattgaaggtgaaagtcacctatgatgacaagaaccgggtggcacagaagcagtaccgtgtggacggaaccggacatcagaccagatatctctacggagacgtggcaaaacagcagaaaccgggacttggatatggcatgcagatagacggaaagacctgtatagagtatgcatatgacctgctgggacgatgcaagaagaaaacacagatctatccgtccggcaaaaagaaggagatcacatatacttatgtgcagggaataaaagaaggaaccacaacagcactggtaggaacgatcacggaaaatggaaaagagactgcttacacatatgacggacgaggcaacattctggaaatctgtacaaaagcactggatacaggaaaggtaacggatcatatgctttatacttacaatggaatgaatcaggtgatccgggaagaagatgcagtcagaggaaccacttatacctatacgtatgatctgggaggaaatcttctggaaaacaagaaatatgatcaggtaaatggagtggaagagctgagaggcacggatacctatacctacaactcagactggaaagatcagttgacctctttcaatggaaaggctataacctatgatgcgatgggaaatccgctttcctatatgggaatgagcctgacctgggaaaagggacggcagttaaagactctgaagaagagcggaacactcagccagtacgtctatgacaatgacggaagaagaatccagaagaccgttggagacaaggtaacccgcttctatctggatggggataagatcatagcccagaaagaagaaggcggagagagaatggacttcctgtatgatgagaaagggacaccgtttgcctttgagtatcaggaaaaaatgtatttctaccagaccaatcttcagggagacatcatcgggattgttgacagtaaaggaagccaggttgtagtatatagatatgatgcatggggagaagttctggtgtcatcagatgcatcaggattcggtcttgcacagatcaatccgctgcggtacagaggctactattacgatcaggagacgggactgtattatctgcagacaagatactacgacccgaaggtgagaagattcctgaatgcagatgatgcgagtgtactgacgaaggatccagagcagctgacggagaagaatctgtatgcttactgtgatgataatccagtgatgtatcgggatgatgctgggatgtttgtgattacagtagctcaagtggggcttggtgtactcggaatggtaacaaacgtggcgacatgttatattgcggcaaaggcaacgggacaggagtttggaattggagacttggtaattgctgccgcagctggtttcgttggtggttgcataaaaaataatttttatgcaacagtagctagtattcttatatcaggagtgggaactactttttatagtttattttgtggagataatttgaaaacagcattatggaaaggtggaatgacgatagtatgtacggctgtaagtgttagttcattaataggagtgaagtcagatatacctatagtagtgaataaaatatcaacaggcatttttggaatgggaaatagtttgactacaacaggtatagtggcatcattttcacatcaaaaaacaaatacgaagaaaaatcatacgcagaatcaaagaaagtcaaaatcaataaataaaaatagtggaaagaagcaaaaagagagagcgttaaggtattttatatttaagatgaatcaattgagagaaagataaaagcaatataagtatggaaagagcaaagagttatttgctctttctgtgaaaggtcaggtaatggaacaaaaagaaaatagcgaaataatagttataaaatcagataaggaatggatacaggaaataaaggctgatacgacgtcacatgttattggtagtgtggggataatagcagggattagttttgttttgttatatccatcatcggtgcctaaatgggaaatagaattattaagcagtcctttgataatagttacaatattattcatattagatatttatcgtatttggcgaaatataggacgagaattagtattggataaaacggggattttgattaagttatggtttaaagaaaaaaagtatggttggaatgattttaaattcagacaagtacgaaaaaatataggagagtattgttatgatgagggattatttcttacgaagcacaagcatcaaccgagacaaaacagtaattgtgaacttttttccataagatatccttctggcagtgttgttattaattttaagatgcatagacctattttggctaatcaaaaaactcagcaatatataaatgctgaaataatggcggtcgaaaaagaagagttgctttccaaattaaaagaatggggagttgattttgaaacagagcgcccgaaaaactgggctatttttcaggacaaaaagggaagattacagtccagaagaaatggaaccgcctggatcttactcgcggctgctgtttggattttacttttaagttttatcatatatccaatctttatctggaagaatccagtactgattgctatctttattccattttttatagctcttgttccagtttatgtggtagtaaccagtagaaaaagttaccgtttaaagatggatgaaaaaggctgtatccgaaagtttcttttcctgtcaaaacgttatttgtggaaggatttgcgggtaaaactggttgcatcggaggaaagtcattgcggagagggcgttttattcatcaagaaaaaatctgggaatagcagttctgcaagtgaaactttcagctatgcatctttgcacccatacagtagctttgtagcaaactttgaagtgtttgggaaaatgtatggagagaaggatgcgttgcatgagattaacaaagagctgtttctggaaaaaatgaaagaatggggagtggaggtagaaggattgccgaaagaagagtaaaaaattaaaaacagagttagaaagcagttggctccttggatgagtgtaaaagttatattttacatttcaaaagatcagagccaactgcttttgtgttgaaggagaagatcaaatgaaacagaagatatttatagcaggaagtgcgctgatcagtctggtggtaaatttatttggtggctgggatacagcgcttgaaacattaatcctgtttatgggaattgactggtttaccggaggtgttttactgccggttgtatttaaaaagagtccgaaatcaaaaagcgggacattggaaagcagagcagggtggaaaggattatgcagaaaagggatggtgttgttatttgtattgattgtagtaagactggatctgctgatggggacaagttatctgagggatacggtgtgtattgcatttatagcaaatgaagcagtgtcaattgtggagaatgcaggcctgatgggagtaccgataccggaggtgatctgcaagacgatagaagtgttgggagaaaaaggaaaagatcctgaaggaagtaatttgcagaaataaaaacggactggaagactccttcagggagacatcatcgggattgttgacagtaaaggaagtcaggttgtagtatatagatatgatgcatggggagaagttctggtgtcatcagatgcatccggattcggtcttgcacagattaatccgctgcggtacagagtctactattacgaccaggagacgggactgtattatctgcagacaagatactacgacccgaaggtgagaagattcctgagtgcagatgatgcgagtgtactgacgaaggatccagagcagctgacggagaagaatctgtatgcttactgtgatgataatccagtgatgtatcgggatgatgctgggatgtttgtgattacagcgacggcgatagaaattgcagttggagcgataataaacatagcaacatcgtatattgctgcaaaagcaacaggacagaagtttggaataggagattgtggggttgcagcaatagcaggagcagtgagtgttattattccaagaagttttactgcgatggttgcaagtgcattttttacaggtatgggaactactgttttgagttgtatggcgggagatggattaaaaacagcaatcagtaaaggtgcaatagcaggagcgtgtatgtatatgagtattaatacatatatggctataagaatacctattactaaggagatgccttcattagcaactacagttttcggtgcaggtagtaatataatggcggctactggaattgcagtgtattcatctaaaaggactaatggtaaaaaatatcaaaagactaataataatcaaaaaaaatataagaaaacaagtgcaaaaaaatatttatccaataacaaaagcaaaagttggaaatattttgtatttaaaatgaaccaattgagatattaacaaaaaatagaaagagcgtagaagagcgctctttctagaaaaataatgagaatgcaagaaaaagtaatagataataaaaacagattaatagtaaaatcaagttcaacatggattaaatatagaaaaatagaaactttaggtatattaagtgcctatttggtattgttggtaggggtaacaatattagatagaaggaattttttaaaagacctagtattgctttgtgtgcttttgtgtttaattatgcctttatggttatggatggtatggaatgaggggcggacagtttttattgataaaaatggatgtacgatagaatttctatcgttgtataagaaaacgtacccgtggtcaaagatcggagttaggcaattaagatcaaagattggtgtttgggaatatgaaggagttttattttctgcaagtaaaagtaaaaaaacattagccagccataagtgtacggaatatttgctgaaacatccactaagtagttttgttgttaattttgaaggaaaacataaccgtatgactttgggaagaccatttttttatgattctgtagaaaaaccatctccatttgtaaaaacaattcatggtgaaataactgcagtagataaagaaatatttttgaagaaaatgaaagagtggaatgtgaaactggaaacggaaaggagtattgataataacaattatttatttggaaaaaaagcaataaaaacaaaagaagtagaaggacaatggaaactcattatggtgggaattgaggtagtgttaattgtagttttaataaaattatattttctggggaaaaatatggccttatccttggctgtaagtccaatattatttattattacaacaatatatgtgtatcttaaacaactaaaaggatatagtttgataatggatgaaaaaggttgtgctcaaaggtttcttttcttgtcaaaacactattcatggaaaaatcttagagtaaagctagttgcatcggaggaaagccattgcggagaaggtgttttattcatcaagaaaaaatctggaaaatctgggaatagcagttctacaagtgaaactttcagctatgcatctttgcatccgtatagcagttttgtagcaaactttgaggtgcctggaaagatgtatggagagaaagatgctctgcatgagattagtaaagagctgtttctagaaaaaatgaaagaatggggagtagaggtagaaggactgccgaaagaagagtaaaaaactaaagacagagttgaaaagcagttggctccttggatgagtgtaaacgttatgttttacatttcaaaagattagagccaactgcttttgtgttgaaggagaagatcaaatgaaacagaagatatttatagcaggaagtgcgctgatcagtctgatagtgaatttgttcggtggctgggatacagcacttgaaacattaatcctgtttatgggaattgactggtttaccggagggattttattgccggttgtatttaaaaagagcccgaaatcaaaaagcgggacattggaaagcagagcagggtggaaaggattatgcagaaaagggatggtgttgttattcgtattaattgcggtaagactggatctactgatggggacaagttatctgagggatacggtgtgtattgcatttatagcaaatgaagcagtgtcaattgtggagaatgcaggactgatgggagtaccgataccggaggtgatttgcaagacgatagaagtgttggaagaaaaagggaaagatacgggtgaagaatctttaaaataatttgcaaaaaggatgtatcaggaattattgacagtatggaaaataaggcggtaagatacaagaaaggaggggtgatagaatggaagaaggattagttatcaaatcagataaagaatggatacaatactttaggtctcgagttagtggaataatcccttttatgttaatggagattgtagttgtgatagctttcaactatgatttacgaaagagaaactcggtcatacctgaaatagccgatgttttggagaaatgtataatagtgggatttataatagtaaatatattttttccataaaatatttatcgaatgtggagggatataggacgagaactaataatagataaaacgggtgttttagttaaaatgtgtttttacgaaaaaaaatatgagtggaaagattttaaaatcaagcaattacgaaaaaatttaggagagtattgttatgatgagggattattttttgcgatatacaagcatcaaccgaggcaaaatagtaattgtgaatttttcccaataagatatccttttggtagttttaatattaatttcaagatgcatagaccaattttagcagtgccaagatactctatttatataaatggggaaatgatggccgttgagaaggaggagttgctttcaaaattaaaagaatggggagttgattttgaaacagagcgcccggagaactttgatatttttcaggacaaaaagggaagattacagtccagaagaaatggaaccgcctggatcttactcgcggctgctatttggcttttacttttaggttttatcatatatccaatctttatctggaagaatctagtactgattgctatctttattccattttttatagctcttgttccagtttatgtggtagtcaccagcagaaaaagttaccgtttaaagatggatgaaaaaggctgtatccgaacgtttcttttcctgtcaaaacgttatctgtggaaggatttgcgggtaaaactggttgcatctgaggaaagtcattgtggagagggtgttttattcatcaagaaaaaatctgggaatagtagttctgcaagtgaaacattcagctatgcatctttgcatccatacagtagctttgtggcaaactttgaggtgtttggaaaaatgtatggagagaaggatgcgttgcatgagattaacaaagagctgtttctggaaaaaatgaaagaatggggagtggaggtagaagggctgccgaaagaagagtaggtgatgaggaaatggaagaagaaaataatagaatattggttgtaaaatcagatgaaaaatggatgaaattcagaaaagaagcagttattgcgagtttgatattagaactaatgtggtgctttttattaaaaccacctgtagtatttgcaatagtttcgcctccaatgatcggattggtttattcattgttttcttggatacaagacagtaaggtattgacattaaatgagacaggatgttgtataaagtgttttttgtacaaaaaaatgtatacatgggatgaactgaaaaatagacaaatgcgtgtaaagtatggggattataaagaaagtattttaatgtcaacgaatgcgataccggaaggaaaatataaatgtgcaatgtttatgtttcaacatccctttaatagttttgtgatcaatttttgcggattgcatgaaccgttctattttggtacagggaagaatggaagtagaacttatgtagtagaaggtgaagtttgtgcaattgataaagaccttttcttcaaaaaaatgaaagaatggggagtagctattgaaaaggtaagagtgatggatgagtctatattttatgataagtcaggaggaatttgtacaagacgaaatggatatggctggaaaatattttcgtttgttctggtattaataatgtgcgcgtgtttaatgtttccaattgttgtattaaaagatatgggcatgttatttatttcgattccatttggcatcgtttttctgatagtttacaaagtaataatcagtaggaaaagttattgtttaaaaatggacgaaaaaggttgtaccagaaaattccttttcctatcaaagcattaccaatggaaaaatttgcgggtaaaactggttgcatcggaggaaagtcattgtggagagggtgttttattcatcaagaaaaaatctgggaacagcagttctgcaagtgaaactttcagctatgcatctttgcacccatacagcagttttgtggcaaactttgaggtgtttggaaagatgtatggagaaaaagatgctctgcatgagattaataaagagttatttttggaaaaaatgaaagaatggggagtagaggtagaaggactgccgaaagaagagtaaaaaactaaaaacagagttagaaagcagttggctccttggatgagtgtaaaagttatgttttacaaaataaaagaaagtcaaatcctgtggttaaaaagagttcaaagacaaaaaaacaacaggagagggctcgaaaatattttatgtttaaaatgaatcaattgagagagcgataaaagcaatatgtagacaggaagagcggagaaagattcgctcttcctgtaaaaaggtaatcaaaatgggacaggagaaagatgtattaattataaaatcggataaaaagtggaaagacttttttatagacagtatatgcggatttagtatttgtttgatagggtttgacatatttttgctatattgtgcagtgaatatgccggatcctaataaggaagagggtagagcgatgagcattgtgtttgcgattgcctattcaatagtgataatcttgcgtatttatctgctttgtcgaaatatggatcgagagttgatcttggataaaacgggagttttggttaaaacatggctttataaaagaaagtatacatgggaggaatttaaaattaaacaattgagaataaatgtgggggaatattgttatgatgaagctttatttttggcagcatgtaagcatcagccgaggcaaagcagtaattgtgaactttttccaataagacatccaatagggagtttctgtattaatttcaaaatgcatagaccaatattagcggggcaaagatattctatttatataaacggtgaaataatggcggcagagaaggaagagctgctttccaaattaaaagaatggggagttgattttgaaacagagcgcccgaaaaactttgatatttttcaagataaaaagggaagattacagtccagaagaaatggaaccgcctggatcttactcgcggctgctgtttggattttacttttaggttttatcatatatccaatctttatctggaagaatccagtactgattgctatctttattccattttttattgctcttgttccggtttatgtggtaataaccagcagaaaaagttatcgtttaaagatggatgaaaaaggctgtatccgaaagtttcttttcctgtcaaaacgttatccgtggaaggatttgcgggtaaaactggttgcatcggaggaaagtcattgtggagagggagttttattcatcaagaaaaaatctgggaatagcagttctgcaagtgaaacattcagctatgcgtcattgcatccatatagcagctttgtagcaaactttgaggtgtttgggaaaatgtatggggagaaggatgctctgcatgagattagtaaagagctgtttctggaaaaaatgaaagaatggggagtagaggtagaaggactgccgaaagaagaatgttaaataaaaatactgcttagatatcagaaaatgatattcaagcagtattttttgtcatatagcggaaaaatttcgctcgtataaattaatcgatcgcttccccttttttatatttctcaactacattctggatacgttcgcttggatcaaggatgctgctgatagaagcatcatggttcagtgtatcgatcaccagtgcgatgtacttgctcatgtcgcagttgatgtagtaaggacggctgagcagttccggtgtctgatagatcaggtttgttgtgaggattccgctgatcagtccttcttcgtaagcctggtcgaatttttccataccgtttgtgaaaagtccgaaggttgcagcagcgtagatacgttttgctttacgcatcttgagctggcgtgctacatcaaggatactgtcacctgacgaaatcatatcatcgaggatgattacgtcttttccttctacggaagagccaaggaattcgtgtgctacgatcgggttacgtccgtctacgatggttgtgtagtcacgacgtttgtagaacatacccatatcaagaccgagtacgttggcaaagtagattgcacgtccggttgcaccttcatccgggctgatcgccatcatatggtcagcatcgatctgaagatccggtacatgctttaaaagtccttttacgaactggtaagtcggacggatcgtctcaaatccgttcagcgggatcgcattctggacacgtgggtcgtgtgcatcgaaagtgatgatattgtcaacacccatgcggacaagctcctgcaggccaagtgcacagtccagtgattcacggccgcttctcttgtgctggcggctttcatacaggaaaggcataatgacgttcagacgacgtgcttttcctcctacagcggcgatgacacgcttcaggttctggaaatggtcgtccggtgacatatggttggtattgccgctgagcgaataagtcaggctgtagttgcagacatcgaccatcagataaaggtcttttccacgtacagactcattgataatacctttggcttcaccagatccaaaacgcggtacttttgcgttgatcagatagttcggcttttcgtagccgttgaaaacaagattgtctttctggaaacgagtctcttcctttctccattttacgagatagtcattgactttatttcccatctcttcacagccgtctacagcaataatgccgagagagccaactggaatattatccagaattcgttcgcttcgatgtaacatcagtgttcctccctgtacataagtttcttttgaatgcggatatcatcaccggcaaggcgaagtatcttataatggttgcttatccgggaaaatgtacgttctgtatagttcgtcttgatttcctccagagtaagattagtagaaatgatcgtggatttcctgttcaggatccgatcatttaaacacacaaaaagctgagaaacgacaaagtctgtatttcgttcggttcccaggtcatcaatgatcagcagatcacactggtggatctgctcatataaaagacagctctcatcattccgggtcagtgctttttcaaggagcgcatcgaaaaattcagaggcagtcaggtaaagaacggaatgcagagaatccatcacttcttttgcaatgcagtgactgagaaatgtcttcccaataccagtattcccaaaaaggagcagattaccatgttcggtatcaaaattgtggatgaaattcatacattcctgataagcctgcgttgcaagctcgcgggaattctgaccagaaagccggtctctataattggatgaataataatcaaaattaaaatgttcaaaattttcctgttcgagaagcccttttaagttggactgggtgtagaacagatcaatgatcgcttttaaaaagcaatggcactttttcgtgccgacatagccggtatcctgacagtccggacattcaaaatgctgttccagatagtcttccgggaatccggcgtcggaaaggagtcggcggcgtctgtcagaaagagaccggatatcttccttcaaagaagcgagggcagtgtcatcgcctgcgagcagctttttcgcctgatcaagactggcagaagaaatagaggcatcaatcgatgcaagctccggaaccttctggcaggcacgctcgtagtgaagattcgcgaggtcgcggctcttcgctcttttttcttcatatacgcgcatcagcgcattgtattgtgaattagttaacggcacagtgttcccctttcttagttactgcgtaataattctttggtaagctcgtccatattgtaagaacgttcttcaaaattacggaatttggaaggctgctgggcagaaggtgtacggttttgccccgaaggagttttcctccggtctttttcctgctcaaaggcagaatcaagacgctcaacatctgccagtgtacgaacgttgcccgtcttccagttttcgagaatcttgtcagtatattcaaaacttggctggtggatcgcactgatggtgcggttgcatgcttccagaatgagatccagttcgaaattcccatcctccagccatttgcggatataatccagttcggcagatgcaggtccccgccctttgatgccaaatgcattcaggatagaatagcaggttttgttgtaaaatgcagaggaattacgtgcctgatcgacggttgtaatatgttcatctgcccatgaaagtgctactttctgaatgtaatgcatgctcttatgtccgttctccacacagtattcgatcagatactcgatcaggtctgcggaaaaaccaagggaatcataaaagtaggtaatcgcatcaacatcggtacgggataaggttttgccaagatattgttcagcaataaaaagaatctgctttaattctcttcttgcagcaagggaacgtcttgatgcaggaagattctgaccggcagctttgtctgaaacagtggtatttccatcagactgcgtgaccggagatttttcatgaacggaagcagactgtgcggaaggtgtatggaaagccgctttgacaggtgtctgatgagttggtgcttttccgatacagattccggcgagttcatttgtttcgtcatattcgagagaaagaattccttctttttcccagtatttgagtgcgcgcaggatatcgccttcggtattctccagaaggtctgccatctgcgggatatccggaagctgctccgggatattctgataacggagaagaagaagatagacttttacatattctccgttcgcagataccatataatgatcgataaagtcattctccacgatcgttatgttattgtgggaatgattgcgcaaaataagtgcactcataatttccgcttcctttcttttctgactttgttcattataacatcatcccagattgtaaaaaagaattttctgacggaaatttttgttattacagataaaatttcgcaaatattggagaaaatcaagcttttaacaggtcttccccaatggttacaacatctccggcacccattgtgatcagaagatcgccaggctggcaatgggtggtgacgaattcttcgatggctgcaaagcttggaagataagttgcgtcacatccatgttctttgactgcatctgcaagctgtgtagaagagatgcctaaagtatctgtctcacgcgctgcatagatgtcagcaaggattacatggtctgcatgtgcgagtgcttcagcaaattctgagaataatgcttttgtacgtgtataagtatgtggctggaaaatacaccacagctttttatgtggataatgtgcagcacttttcagcgttgcagcaatctctgtcggatggtgtgcgtaatcatcaatgatggtcactccgccgacttcacctttgtattcaaaacgacggtctgttccgtggaaggaagcaagacctgtctggatcgtctccgcaggaacaccaagaatatcggcaactgcgattgccgcaagtgcgttatatacgttgtgctcaccgccgactgcaagagcgagatgggcaacattctgtccgtcttttacgacatcgaaagaggcattgccctgttcgttataagtaatattggctgcactgtaattcagggaagcttctttgccaaaagtgataacacgacaggaaagatcggaggtgatctcttcaattttatcaatatctccgttgatgacgagagttccgttttccggaagaagcttagcaaaaaggtggaaagaattacggatatcgtccaggtctttaaaaaagtccaggtgatccgcatccacattcagaataataccgattttcgggaaaaagtgcaggaaactgttggtatattcgcatgcttccgtaataaaaaggtcaggtccgccgacacggatattgccttcgatcgctttcagaataccgccgacagagattgtcggatccaggtctgctgcaagagcaatatgagaaagcatagaggttgtggttgtcttaccgtgtgtaccggatatagcaaccggtgtcttatagttagtcataagctgaccgagtaattctgctctggataacatcggaagattctgacgctttgcttctgcaaattcttcgttgtcttcgtggatcgctgcggtataaactacaaggtcgataccgtctataatattggaagctttctgaccgtaaaatacggttgcaccattctgagacagatgatccgtaagtgccgattctttgttatcggatccggatactgtgaagccttcttcaagaaggatctcagcgagtccactcatactgatgccgccaattccgatgaagtggatatggcaaggctgattaaaatcaattttatacataatgacacttcctgttctgtgaatttgtttcatagtatttgacttacgtgcataattataacatagataggtcaaaaaccaaaccttttctttttgtgatatttctataaaaaagataggtaaacagaaatatttttgtaaaatatgttcactatatgtatgtaatatgttataatgaaaaaaccagaattactgagaaggggtgaagacatgataaaaaaggaaatgatagcaatgctattggcaggaggacagggcagcagacttggcgtcctgactgcaaaagttgctaaaccggctgttgcatttggcggcaaatacaggatcattgattttccgctgagtaactgtatcaactcaggaatcgatacagtcggtgtcctgacccagtatcaaccactcaggcttaatacacatattggaattggtattccgtgggatctggaccggaatatcggaggggtgtcaattcttccgccgtatgagaagagtacaagcagcgaatggtatacaggaacggcgaatgcaatttatcaaaatttggagtatatggagacatttaatccggattatgtactgatcttatcaggagatcatatttacaagatggattacgaggtcatgttggattttcacaaggagaatcatgcagatgtgacgatcgcggcaatgccggttccgatcgaagaagcaagtcgtttcggaatcgtaattaccgatgaagacaagagaatcaccgagtttgaggagaagccggcgaatccgcggagcaatcttgcgtctatgggaatttatattttcagttggccggtgctcaaagaggcactgatcaagatgaaagatcagccgggatgtgatttcggaaagcatatcattccgtactgtcatgaaaagaagcagagactgtttgcatatgaatataatggttactggaaggatgtcggtacattgagttcttactgggaagctaatatggaactgatcgacattattcctgaatttaatctttatgaggaattctggaaaatttatacgaataattcaattataccgccacagtatatctcaaaagaagctgtgatcgacagaagcatcattggcgacagagctgagatatacggcgagatacataactgtgtgattggcgcaggtgttgttgttggacaaggctgcgtgatccgggattcgatcatcatgcaggatgttgcgataggaaatgactgtgtgatcgacaaagcgatcattgcggagaatgttaaggttggagataatgtaacccttggaatcggtaatgaagcaccgaacaagctcaggtctgatatctacaattccggactggttacgatcggtgagaattctgtgattccggcaggagtacagattggaaagaatactgcgatcagcggtattaccgtgaaggaggattatgtacagggtgctcttgaaagcggcggagtattgataaaggcgggtgacagatcatgagagcagttggaatcattttagcaggcggtaacaacaacaagatgcgggagcttacacagaggcgtgcagtggcagcgatgccgattgcaggaagctaccgggcaattgattttgcactcagcaatatgtccaattcgcacatccagaaggtagcagtacttactcagtataatgcacgttcactgaatgaacatttgaattcttccaagtggtgggatttcggacgtaagcagggtggtctttatgtatttacaccgacgatcaccgcagacaatggctactggtatcgtggaacggcagatgcgatctatcagaacctggagttcctgaagaggtgccatgaaccttatgtgatcatcacatccggtgatgcggtttacaagatggattataacaaagtactggaataccacattgccaagaaagcagatatcactgtggtatgccgggatttggatcagggcgaggatgcaacccgttttggcatcctgaagatgaatgaaaatatgcggatcgaagactttgaggaaaaaccgatggtggcaaattccaacacgatttccacaggaatctatatcatccgcagacgtcagctgatcgatctgatcgagcattcagctgaggaagacagatatgattttgtaacggatatcctgatcagatacaagaatctgaaaaagatatacggttataagataaaagactactggagcaatatttccacggtcgatgcctattataagacaaacatggatttcctcaaaccggaagtccggaactatttctttaagcagcttccaagtatttattccaaggtgacagacctgcctccggcaaaatataatccgggtgcggtcgttaagaacagccttgtggcaagcggaagcattatcaacggaaccgttgagaattcggttctgtttaaaaaagtgtttgttggaaataattgtgtgattaaaaactcaattattttaaatgatgtgtatcttggggacaatacctacattgagaactgtattgtagagagcagggatacgatccgtgccaatacacggcatgttggtgaagatggcgtgaaagtagtaatagaaaagaacgaaaggtacgcattataaaaactgagggggacttgtaagagtccggatcagaaggcatgccggtcaaataaaggaaaaggagcggaccggtatgtgcgttactggagaaaggggctagaaagttatgcagattacagatgtacgcgtgcgcaaagtagcaaaagaaggaaaattaaaggcagtagtatcaattacaatggacgaagaatttgttgttcacgatattaaagtcattgaaggggaaaaaggacttttcattgcaatgccgagtaagagagcactggatggggaatatcgtgatattgcgcatccaatcaattccggtacaagagacagaatccagaagatcattctggacaagtatgcggaagtactggaagagactgacgacgcggaaactgcagaaatctaagtacagaaaaatactgaaaacaaaaatcccggagactggaagtaaaaccagttctccgggatttttatattttgagaaatgatatttctacgacggtcaatcgcgcataaactgatcgatcacatagagaactccgtcatcatcatttgattttgtgataaaatctgctttttcacggaccagtggctgtgcattttccattgccactccaagacctgcggtttcgatcatagtcaggtcgttgtatccgtcaccgcagcagatcatttcatcagcagtcagaccgatgctggtaagaagcttcagaagagaggcggctttgtctacattctttggaacaatttcgaggaaaaatggatccgaacagtaaacatcgatataaccatggaaatgagcggacatttcctctttagcagcagcgatgctgtccggttctccggtcaggagaaatttattgtttggaaatgtggatactttctcgcagaaattatcaatttgtacaattggtaaatggttgatccgggattctaattcggaatattttgtcggggtaaatccggacagaagctgtccatcctcataagccagaagatcaaccgggtagttggaagcgatccggtagatatccgggatcacgtcctgcggaagtgttttgttgtaaatgacctggccggtgcggcagtcagtgatccgtgctccgttgaaggacaggatatagcttccgtaacgttccagatggagctgcctggcaaggggaaccacgccgtatgtagggcgaccgcttgcaagaacaactttttttccggcttcctggatctcgatcagagcctttaacgttggtggagtgatttctttcctggagttggtaagtgttccgtccaggtcaagaacaagtatctgatatttcatgtcttccctctcttaaaacttcatctgtctgagtacatcaatgatctcaggaaattccataccgtgggaagctttgaccagaatggtatcatcttttttgacaacattccggatttttcccaggaagtcctgtttggttttaaagtaaagtacggcactgctctttgcacaggcttttgcaccttcatatgcgtggtgggaaagttctccgatacagcagatcacatcaatgccgatctcggcagcatgtgcgccggtattgtagtgaagttcattttccttatcaccaagctcatacatatcgcccattacagctacggttcttcctgtcgcggtagaaagtacatccagagaagatttcatggaaaccggattagcgttgtagcaatcatcgatgatcaaaagagatcctgtgtcgatcagattggtacgtccggcaatcgtcttcagggaagagatcccggtctggatttcctccagagtaagtccaagcttcatgccgacacatgctccggcgagagcattgtagaccatgtggtttcccggcaccgggatatgtacgttgatttcaccaagtggaaggtggagtacagcgtcagttccgcgaagtccctgacttacgattccgtctgcataggcatccagctggtctgaaagaccgaagaaaacaggctttttcccttgtacctctgcgactgtggaaagtttgtcgtcatctccgtttaagatgacagaagcatttggacgtagatgatcaaaaacttcggttttggcttttaagattccgtcgcggcttccgagattttccatgtgtgcaagaccgatgttggtgattacacagatatccggctggctgatggatgcaagttcatgcatctctccgaaatggtcaattcccatctccaggacagcgacttcatgttcttcggtaagattgaagatggtaagcggaagtccgattccattgttaaagtttccctctgtcttaagaacattgtatttccgggaaaggacagaggcaatcgtttctttggtgctggtcttgccaacacttccggtgatgccgacaaccttgatgtcaagctgcatgcggtaaaacgctgcgatatcacgaagtgctttttcacaggattctacatgaatgcagggacaggtaagggaagaaggatcttcttctgtaagagtagcaagtgcaccctgttccataacctgtgggataaaggtgtggccgtctacgcgggctcctttgagtggaacaaaaagaaatcccggtgctgctttccggctgtcgattgcaacgccggtaatctctttttcaagaaaactgctgtcgccatggaaggttccatggcaggcagcggttatattttttaatgtcatatttttcatcggtaatacctcttttcaaattgtgacctagtcatcagcactcatgcggtcaagaagctgtttctttacttcataaagtcttggagacagatcgatatacatctggtgaggattgaagagtcgtttggattcatcccacagggtatctttttcctgacggcagtaagcggcaatctctttgacagacggggaagtgtagacacattcaccgttgatgaagattggctgcatcatttcgcggacggtataggttccggctttcatctttgtctttttccatgtctcgcttggatcaaagaggagaagatcttcctccggattgatttcttcgtctacaaagcagatataatcagctttcatcttgccggtttctttttcgtaaatacggtaaaccgtcttgttgcccggattggtgatcttttctgtgttctcagaaagtttgattttaggttcgaactcaccattcttattctggatggcagcgagcttatatacaccaccgaatgaaggacagtctttggaggtgatcagattggttccgacaccccatgaatcgatcgctgcgccctgcatcttgaggtcgtggatcagatattcatcaaggtcgttggatgcgcagatcgttgcttcttcaaagccggcctcatccagcattttacgtgcttttttggacaggtaggcaagatcaccgctgtcaagacggataccaagctttctcgggctgatgccggcatctttcatctcctggaagacacggatcgcattcggaacaccggattttaaggtgtcgtaagtatcgacaagaagggtacatccttcaggataaagatctgcataggctttaaatgcggtatattcatccgggaaactcatgatccagctgtgtgcatgggttcccataaccggaacgtcaaaaagcttgccggtaagtacgcaggaggttcccacgcagccggcgatcacggcagcacgtgcgccgtataatccggcatccggtccctgggcacggcgaagcccgaattccataacaccggtatcaccggcagcgtatacgatacgggaagacttggtcgcgatcagacactggtggttcagaatgttcaggattgcggtttccacaagctgagcttccatgatcggggcaacgactttgaggatcggctcctttgggaagatcaggcttccttccggaattgcgtaaatgcttccggtaaagtgatagccgctcagatactgaagaaaatcttcagaaaaaatgtggagactgcgaaggtaatccacatcatcatagctgaagttcagatttttcacgtactcaataacctgttcaagtccggctgcgattgcataaccggaagaaaatgggttggaacggtaaaatacatcaaaaattacggtaggattgtcctgcttatcgtaataaccctgcatcatagtcagttcgtataagtctgtaagtaatgttaaatttttagaatgcataatcgtacctcttttctgttataggtttagaccagactggcgtttttcttaattgtgtcctggataagatcatgacaatagattccaagatgttttcttgtttctttatccagttcttttggatagattggtttgccgtattcgatgacgacatgtactttttttacacgcgggaaatgtgcttcaaaaatgtcagcagtattgttcatgctgatcggaatgatcgcacacccggtcttttcggcaattttaagtgcaccgtcacggaatggaagcatagaaagttcttcgccattgttgcgggttccttccgggaagatgcagatggaaatgccattttttacataatcaattgcctgaaggatcgtcttcagaccttctctcatattgtctctgtcaaggaagagacagtacagattcttcatccatgtggaaagaagcggaatcttttccatttcttttttggcaacataaccggtcagacgcctgcaccggctgtaagtaaggagaatatcaaaataactgcggtggttgccgataaagagtaccggttcatccggaacattttcttcaccgatcacggttgtcgtgacaccggtcatcttaagaatcactttaaagccccactgaacgatgcgcagagaactgatatctttggctctgcgattgaatttaccaatgatccattccaccagaaaaaccggaatggacaggatcaggtaaagaattaaaaagactgcgatacagataaatcgtatcattaccccaaaatcctctctttcattgtataaagtaacatacttttcttcgattatactattcgatgcatgaaaatacaaggaagataatatgataataaagagacaaaaaaatggaaaagtttgtgaataattatgagaataaaatgctgtgtgacaggggtgatctggatgctgattttccttggcggctgtcaggtcatggaaaaagaggaagcgggtggagaaatgctggaatattccattgtggatgagaaaaaagttccggcggaaatgaccgaacgcattgccgggatggaagaaaccccatttcagatcatgtatgtgcaaggagaccggctgtatgtcggacaggggtatgggagacaggaaatggagggatatgcgatccgggttgatggctgtacggaagaaaaagatgtgatctgtgtacagacaacacttctgggaccgggaagtgacgagacagaaaaagatggggaggagatgggaaatatctgtatgcgggaagatggattttcccaatacccatatgttgtcctggaaatggcaaaaagcgaaaaaccggtgatatttgagtaggaggctgactatggaactgataagaaaacaggtacgcatgaatcagatgggcaaaacagtgacggatcagtttatgatcggtggggattataatgtaccagatgtgaaaagtgacgtgggaagagtgctttccggtgagggaagtctgcggattgaagagacaagaagagtggaaaattatctccgtgtgacgggaaaactgaattttaaagttttgtatgtgacagattcgggagatccgcgtcccggagctttggagggaatgattccgtttgaggaaatggtctacatggaggaagagaacggagaaggcgaagacattgtgcaagttcagcgggtggaatgcggggtatcactgatccattcgagaaagcttgcggtaaaagcgcttgcggaaatgacggtacatacagagcagattacagaaaaacaggtgacacttgatgtggatggggaagagggaatctatctgaaaaaatgtccggtggagctgctgcagctgtttaccgcgaagagagacatttacaggatcaaagaggagattaagataccggggaccaaagagaatatcggaacgctcttgtggacagaggtaagctcccggaaaatggataccagacttgtgcaggatgctatgctgataaatggagaattgcagatctttgttctctatgaatcccaggagggcaagacagactgggtggagcagacggttccttatgaggggcggatcgagtgtgccggcgcagaagaaggtatgtatcatcatgtctatgaccggctggatgatatcagtgtggaagtgcggatggatgaggacggtgagatgcgtgcgcttggcattgaagcggcacttcaggttcgtctttttgtctatggggaagaaaagctggagcttttagaggatgcgtattcccttgataaaaaatgtgttttggagacagaagaagttgttgttgaggagcttctgatgcagaatcattcaaaaagtaagatcacagaacgattaagtctgccggagctgaaagatgagatccttcaggtgtgtcacagcagcgcagacctgcagatagaaaaaatggaagtgcaggatggaggaattctggcagaggggattctaaatgtcagctttctgtatgtaaaggcaaatgatgaagtaccatttggtgtgtggaaggggatggttccgttctcggcaatgcttgaatgccgggaaggaagcatcggtatgaaatatgacgtcacatatgcagtggagcagcttgcggtagatcttgccggaaatgatgaagtagagatcaaagcggtcgtggcgttcagaagcttcatgcgaaaagcggaaaaaatacagatggtgacagaggctgcacttgtggattatgaaaaagaagagcggatgaatcagccgggaatcgtgggatatatcgtaaaagacggagatgatctgtggagcctggcaaagaaatattcgaccacagaagaaagtattctgcttaataatgaattattatcaaaagaattgaaaacgggtgataaaatattgatttttcgggagagtttgagtatactatagtaatgaaatgatgtatacaagatacaaaaaaaggtcgaaaaaatacaataaggagatacacgcatggataaactggagttaaaagcacttgggaagattaatcttggacttgatgtgctggggcggcgggagaatggttatcacgatgtgcgcatggtcatgcagacgctgtatctgtacgataatgtgacgctgcaaaagaagtcggccccaggtatcgagatcgattcgaatcttttttatctgccgaatgatgaggacaatattgcatggaaagcggcaaagcttctgatcgatgaatttgatatcaaagatgggattagaatccatctggacaagcatataccggttgcagcgggaatggcaggcggaagttccaatgctgcggcagtgctttacggaatgaaccagatgttccggttgggactttctcaaaaagagttgatggaaagaggcgtgaagcttggggcggatgttccttactgcattatgcgcggaacagtactcgcagaaggaatcggggaaaaactgacgccgcttcctccgatgccgaaatgtcagattctgatcgccaagccgccgatcagtgtatcgacaaagatggtttatgaaaagctggattcctgtgaaatcaaggagcatccggatatagatggtatcctggacggattgaagaaccaggatcttgagcaagtggcagcatccttgggtaacgtgctggaaaaggttacggttgaagcatatccggtcattgcacagatcaaagaatgtatgatggaagcaggtgctcttggggcgatgatgagtggaagcggtccgactgtatttgggattttcagggatcgcaggacagcgaaggaagcatttacaaaagtaaaagcacagaatctggcaaaacagatttatcttgcaaatgtgcataacgtcaggaggagataagaatggatatggattttgaagtaaatatgaatgaatacctgccgttgagagatgttgtgttcaatacacttcggaaggcaattttaagaggagaactgaagccgggagaacggctgatggagatccagcttgccaacaagcttggagtaagccgtaccccgatccgtgaagcaatccgtaaactggagctggaaggtctggttctgatgattccgcgaaaaggggcagaagtggcacagatcacagagaagaatatgcaggatgtgctggaagtcagaaaggcactggaagagctttccgtacagcttgcgtgtgaacggatcacgccggagcaggttgaagaaatgaagatggcagctgaagatttccgtaaagtcttaaagagtggtgatgtgacgaagatcgctgaagcagatgtaaaattccatgatattatctttgccgcaaccaataaccagagactgatcacgctgctgaataacctgcgggaacagatgtaccggttccgcgtagaatatctgaagcagaaggaatgttatccacagctcctggaagaacatgataagctgatcgcactgatttcgggtggagaggttgaagaggcatgtgagctcatgggatgtcatattgacaatcaggcctctacagtatcggatgttatccggagagatcaggtagaatatcacagataaaaatgtatagttttccatatgttgtcaatactcctggtatcaaagacaggaggtacatacgaaaatgaaaaaaataaaagcattggcgctggtactgatcatgattctgtgtggtgcggcatttgtaaggggaatgcaggtggaagcgaaggcgaatgcagtgcaggaaaagttatccggtgaggtgttccgctttcatgtgcttgccaacagtgacagcaaagaagaccaggaacttaagatgaaggtgaaagaggctgttgtagattatatgtgtgagaatctttcgaatgcagggaatgcagcggaggcgaaagcatgggcgatccgccacaaagaagaactgatccggacggccagggaagtcttgcagaaagaaggatgtaacgatcagataacagctgaggtcgtgcggtgtgaatttccggacaaaacttacggagacatcaccttccccgcaggctggtacgatgcactccggatcaagatcggaaaggcacaggggcacaactggtggtgtgttctttatccgaatctctgttttatggattctgtccatgcaattgttcccaaagaagggaaggaagagctgcggagtgtgctgacagatgaagagtatgcgatgatcgtaaaaggcacaccggtaaaaatcaaatggtttttcttgcaattgacggagtaaatgtgtagaatatacttcaacgaagatggcaggagaatttgtttcgcctaaggtaaaggaaagtttaatgacggatatacttgtaaaattatttgtaaaagattataaagatgtagaaaaggtgtctgtccgtacagcatatggagtgctggcaagcggagtaggcatcttttgtaatgttctgctgacgattgcgaagatggtgataggaatccttcttcacagtgtgtctgttactgcagatgcatttaacaacttatcggatgcaggttcttcgatcattggaatgatcggagtgaagatggcagaaaaaccggcagacaaggagcatccttttgggcatggcaggctggaatacatagcggcactgatcgtatcctttctggtgatcgaagttggatttacctttttcaaaaatgcgatcgtgaagatccgggagccggaagagttaaaattcagtctggtgtcgatcctgatcctggtgttgtccataggtgtgaagctgtggcttgcgatgtttaaccggaaacttggtgaaaagatttcttcccaggtgatgatggcgacggcagcagatgcacttggagatgtgatcacgacagcagcgacgatcctgtcggttgtattctggcggatcacagggatcaatatcgatggctttgtcggacttggtgtttcactggtcgttatgtgggccggatttgggattgcgaaggatacgcttgagccgctgatcggaattccggcgacatgggaagattatgagaagatcaagcattttgtggaaaaatacgctggaatcgagggcagccatgatctggtgatccataattacggaccgggaagaagtatggcgatcattcatgcagaggttccgaatgatgtcccgattgatgtatctcatgagatcattgaccggattgagagagaggcaatggaacaactggggatctcgctgacaattcatatggatccggtggagactcgtaatgaagaagtacttcaggcaaaacatgagacagaaaaagctgtggaagcactggatccgagatgcagtatccatgatttccgcatggtgaatggagaaaaacagatcaatctcatttttgattttgtcattccgagagagtattctgaggaaaaagggaatgaactgacactgactttgatggaccgattgcagcatcataacccaaagtatcagtgtgttatcacattagacagaagttatgtggaagaacagaggtaaaagagatgtatacatttgaaagcagagtacgattcagtgaagcagaccatacggagcttctgacattaccggggcttgttaattattttcaggactgtagtacttttcagtctgaggatatcggatatggcgtggaatcactgaaaaaaagcgggcaggcatggattctttccgcatggcagattgtagtaaaccgttatccgaaactcggggaacatatccgggtgtccacctgggcaacggattttaccggacttttcggacttcgtaattttaagatggaggatgaagcaggcgagatgacagcctgggccaattcggtctgggtatatatggatatgaaaaaaggaagaccatgcagaccggcgaaagaagaggtcgaggcttatcggccggaagcaccactggatgtagagtttgcgccgcgtaagatcgtgcttccaaaagaactggaagatggagaaagttttccggtaagacgtcatcagatcgacacaaacgagcatgtcaataactgccagtatatccagatggcaattaatgtggtgccggaatgtgagcgtgccggacagatccgggtagaatataaaaaatccgcagttatgggtgatattatttatccaaagatggcggtagaggaacagagaaaaatagtggaactttgtgatgcggagggaaatccgtatgcggtagtagaattcaaggagaaataagagatggaattagggaaaaaacagatgcttacggtagtaaaggtagttgatttcggagtatatctgggagatgacagagaaaaggttcttcttccgaagaagcaggttccggcaggaatcgaaccgggcgatccgattgaggtgtttttgtataaggattcttctgaccgtctgatcgcaacggtaaatgaaccgaagcttacactgggggaaagtgcaatcctgaaggtagcgcaggttggcaaattcggtgccttcctggactggggactggaaaaggatctgttcctgccatttaaggagcagacttataaggtgaaaccgggggatgaatgtctggtaggactttatattgataagagccagagactctgtgcgaccatgaaggtatatgagtatctgaccagtgattctccttatcagaaggatgatcaggtagagggaatcgtttacgaagtgagtgataatttcggggctttcgttgcagtggacggaaaatattctgcgcttgtgccaaagagagaagcaccgaaaagtctaagaccgggaatgaagatccatgcgagagtgacagaagtaaaaccggatggaaagctgaatttaagtgtccgtgagaaagcatttatccagatggataaggatgcgcttctggtactggcgcgtctggaagaaaagggcggagtccttccgtttaacgataaagcagacgcggagctgatccgtgcggagtttgatctgagcaagaatgcattcaagcgtgcagtcggacatctgtataaagagcgtaagatcgagatccgtaagaacagtattgttttgaaatagacattgtgattatgcacaaaaaacagactattaaattgttcacaatgcccaaaacgctgatttgaaaaaaaacccttgattttcaaaaaaaaattgtatatattgagggtgtaaaagataggaagagataaaagaaaaggagtgtacatcatgaaggtacagaatattacaaacattgataagttttttgaaatagtagacagctgcaaaggaaaagtagaacttgtaacaggagaaggcgacagactgaatctgaaatctaaactttctcagtatgtttctatggcaaatattttctctaacggagagattccggaactggaaatcattgcatacgaaaaagaagacatcgataaactggttaacttcatgatcaatggctaatttatataaataccaggaatagtgagaagcaggaatcaaagaagatttggttcctgcttttttgtgtatacgatgagccaactgcagatttgtgcttgcacaaggatcggcagttggcgaatgtacatcatcgagctgttaagcgagatggtgtacaaagtatacaaatcgagtaggagtcagcctgcacaatggacttcacacctattctttttctaaatccgccctcaagactttgggcgcagacctggcggctgctaaacataaaaattcaggaaactatagagagatagtttcctggtatatgagagagggtatttatattgagggtgggttaggttagtttgcgcgtaatgattcaataaatggtgtcaggagggattcaccgtattgaagcagggagaagcttctctgggtgagacaccaggagtaggtgagaccgatctgggcagaggtgatcatctgggagagctcgacgtaggagtagtctgactttagttctccacatttgatcccgtcgaaaaggatcttgcgcaggatcttataataattacgatccgggtttaaaatatgtctggttccggtagtagctacctgaagaccgtagaggggcgcaaagagatccatatatggtgagtgctccaggttattcagcacaaaatggttgaaggcgagcagcagatcggcggctggaagcgtccggtcgcaggtctgaagccagctatcatagtcactgtcgtaggaataggcgaggctgaagagaagttcatcttttccacgaaaatggtggtaaaaggtgctgcgggaattaccggagagttcgatgatctgcgcgatcgtagtttcgtcatagccctgttctgtgaacagcttccatgctgcatccatgatgtcctgttttgcatgtcgtttgccgtgcgttgtcataattgatcgttcctgccttcttaaaagtattgaagctattgtaacacagggatgtggagagtgcaatgttttgtttctgcatacattttattgaaaatgtccatataaggataatatggttgactttatttgaacactttagtagaatgaagggtataaaaagcagaacgtagttcggaatacagtatctttttagaccgtagtacgaaaacgaactacagtgcttttggaggtgtaagatggaaaaattaaaacttgcagccggcatgacaggagaacagaagcgttatgcggttgaagcagcactacttctgggatttcagacagagacagctacatttccggtgatcacagcggacggtgagattccggtgccggagaatatggaagagctgaaagccctgtggaaaaagagtacaggggagacaccggaagagtacgaatcagcatcaaagcatacaggtccgatctttgatctggatttccgtaaggaaaaagggctggagacgatgcttcagaaaggggatttcctgaaagacgagaatcaggatcttcttccggatgtgttggatgtgaagattgtacttccggaggatgcagatgatgcgatgctcgttgcagcatgtaacctggcatggcgttttggtatggagacaaccggatataaaggaactattacggcagatgcagcttatacaggcaaccggctcgttctggaaaaagcagagcagacagagcttgtacgggaaaaagaaggagaaagtgtaaaagtatctcttcgcggtgacggagaggaactaatcgcatttacctcccgcctctgtatggaatttccacagatcaatggtcagagaagctggaaagacctgctgatggatatggtggatgactttgtactgcgcggcgcagatggccagcttgcagctttgaaagcgatgcagaaagagcagacaggagaatacgaagtgtacggatctccgctctggaatgatacacagaaaaaagaagccggggatgcaaaggtatataattacaaatccggacagaagatgtacgagaaggtgtatgagcttccgtgggaagtggaagtttttgaaaaacttctggaagaaaaggtttatccgcagatcgggaaaggaagcaaggtaaagattaccggtgcggtaagtgaaaatataaaagtacgtcagaagataaaagaaaaaatcgaagacagaatccagatgttaggtgccaagccggaggatacctccgttatctgtgcatacaaacagggatattcctggatcgttgaagagatgcttccggtgatgaaggaagcgcaggcagatcaggttgagatttatttcaaaccgttcctgccggaaggccagacagactggctggatgagaacggtgcaaccccgtcctatcacaatctgaatgcagacactccggacaagtggtatgatcttccgatccgctatctgcaggaactgtatccggtagaagatattctggtaaaagagcttggaattgaaagagataaagtcattttcaaagcttatgaaggcgaagaagatatcacttatctctgcaaggggatcaaggacgaaaaggtctgctgtgaggatacttacaaagcagtctggtcggaaagaccatatatggatgaatatccgcagatgggaaaggttcatccggcaaccggttatgtaaaagcagagattgacggacaggaagtattttatcagaccgtccgtaccgatatggaagagatctgggatgtttaccagaaggaagttcttccggattgcagacgatatattgaggaaaagacaggcggaaagatttccgcagacctgcagccgttcttccatgaactgcgtctggacgtgaccgcaagtgaaccggactatgcgaccggatcaagagaggatctgatctcttcactggatgctttgcatgaagatatgtattttgtcggaagcgactattttaaaaattacggtgtgaagaaagcagatgtcatgctggatgcgccgggactgatccttccggtgatccatgaaaaagaaggcagaccggtatttaaggtgacactgaccgagccgttaaaagaagaagcatgcattgtaaaagatggaaaagcggttcttttacagagaaaacgcgaagaagcagatgcatggatccgtgccatttcatgggaaaatgataattttactttccatatccgcacaaatggtgtacaatctaatgtattacacacttactcaacattgtggtcaaagggtgtactggcagagtgtgaaagtgttgctgcaggtacgaagcttttgtttgaaagtgagcagggcgagatacagtatgcagcacttacaccggaaagagaagaaaaaccaaagacgaaacggattgaagagattgacctgcatgagcatgaactgatcggatatgatacttaccgtgagatcatcgaagaactgaagcaggttcctggaatcgaagtgttccgaactgcggtatcttatacaggacgtgaactctatgcagtatggatcaaaccggaatacgaaggatatctgtccatgacgaagcgtatatcaagaattcctggcgagatgatcaatgcaagacatcatgcaaatgaagtatcttcgacaaatgcagcatttatcctgatcaagaagctgctgacagaagatgtttacaaagatttaccggataaactgaatctggtgatcgttccgatggaaaatgtggatggtgcggcaatccattatgaattgcagaaagagcatccgacctggaaattccatgtggcaagatttaattcgcttggaaaagagttctactatgaacatttccagcaggatacgatccacagcgaggcgatgggattaacccgtatttatgaccggtatgtcccggatatgatcgtggacaatcacggagtaccgagccatgaatgggagcagcagttttcaggttatacctccccgtcttacaaaggcttctggcttccgagatctctgctttatggttatttctggtatgtgaccaatccagagtacaaggacaattacccggtcaataaggtaatggaagatgtgatagcagacaagattgccgagtatccggagatgagagaattgaaccgtgaatggagtgctcagtttgaaaaatatgcacatgcgtggatgccgaaattgttcccggcaaactattataaagaaatgattaactactggatcccgttcgcggcagatccaaaccatcgttatccgtcgatccgttttccgtggatcacaacggttgcttataccagcgaggttgcagatgagaccgcacagggtgaatacctgaatttgtgtgcaagggctcatgtggcacatgacgaggcgactatccggatgttgatggaagcagtgcatgtgatggaatgtcatctggaagagcaggatggacagattttgaccagttacataagacagcgtccgatgattgtcaaagtgactggaaaaaataaataactttttaatacttttctaaaggaggagttaggtatggaactcatcaaattacttggcgtgttaatcgtaatcgttggattcgcgctgaaactggattcaatcctcattattttcctggcccttatcgcgacagggattgttggaggacttggagtgggcggacttctggaaacaatcggtacaaactttgtagcgaacagaagtatggcaatctttatcatgatcctgctggttacaggtacactggaaagaaacggtctgcgtgaagcagcggcaaacctgatccgtaaagtaaaaagtgcgacagcaggtaagcttgttgctgtatatggtatgctgaatgctctgtttggagcattcaatgtcagcttcggtggagttgccggatttatccgtccggtactgcttccgatgatcgaaggtgcgatcagcaataaagaaggaaaagcaaatgaagatcacgtagaagaagcaaaaggacttgctgttgctatgcagaacttcacatggttcttcttccaggtactgttcgtaggtggtgccggcggaatccttgtacagacaacacttgcaggtcttggatacgaagtagaactgatcgaccttgcagcagctgaaatcccggtagcattagttgcacttgttgtttcctgcgcatttgttattttgaaagataacaaactgatgaagaaatactatggaaaatcaacagatactaagaaatagagggaggaagacagatgagtaatttaaaatttatacaggtcggcgattcgtttaatgcaatcggactgaatgtagtatgggtaattatcggattgatcacgatttacgcaggaatcaagaacctgctggataaagagaatccgtcaagagtcggaaccgctgttttctggtgctctttcggtatcgtttgtggatttggttcatggctcccggcaaaggtttctggtgtgcttgttctgatcatgtgcctgccgccgatcttcaagaaagtaaaaatcggaaaaacagataatccgacaaaggaacacacagaacagcagtttaagaagatcggaatgaagatatttgtcccggcattctccgtagcggtatgctccctgttctttgcattattcagtaatatgagttctatggtcgcaattaccgttggtgtgattgtagctatggtcttactgatggcattcgatacaaaacagaataaaccggcagtctttttgaatgattctgaaagattccttggaatcacaggacctctcagtatgctgccacagctgcttggatgtcttggaggtgtatttaccgctgcaggagttggcgatgtaatcgcacagcttgttgaaaagattgttccaaagggaaatgtaaatatcgggatcatcgtttatgcaatcggtatggtactctttaccatgatcatgggaaatgcattcgcagctatcaccgttatgacagttggtatcggtgcaccgttcgttcttgcttacggtgctaatccggtggtgatcggtatgctcgcacttacatgtggatactgtggaactctgcttacaccgatggcagcgaacttcaacatcctgccggttgcgatcctgaacatgaaggaccgctggggcgctatcaaaaatcaggttctggttgcaatttttatgcttgtgttccagatctgttatatgatagtattaaagtaaataagacataagtagctaaggtcattatttcactggaaaagcagaaaataatggccttagaattcgtaagcttattctagttttgggtatggagaaagaagagggacatatgacaccgaatatggaacggggtgcccggatcattattcacgaatgggtaaaagtaagggcgtgggacaaagtactgatcgtgacatcgaaggaatatcttgcagaagcaaaagcaatggaaaaagaggcttccggaaaagcacggtcagtgaatacactgcttgtcgagaacaagggacgccatgtgggaatcttttttgatgataatgaagcagtttttgatccttatacggcaattatcgcggcgacagagtattcgctggtgacaacgaaagccgcaaagcgtgcgatacaaagacacaagaaatttctgtccttgccactggcaaccaatgacggaagatcttttctggaatacgatttcctgacgatggatacgaagaagagccgactgatggcaaaggcatttatcaaatatctcaagtattcagaaaaagttcgtgtgacaactccggcaggaacggatatgatgttctacaaagtgggcagagatccgggattttttaacggagttctaaaggatggaaagggatattcttcttccagtattgaggtctatgtcccgatcgaggagacaaagacagaaggtgtgatggtgcttgacggttctctgggatatattggtcgcgcagaggaaccgacaaggattttatttaaaggcggacggattacagagattgaagagactccgaccggtattcggttgaaaaaatacatggaagattatcaggatccccggatctatattgcgggggaactcggaatcgggcttaattcatgctcacaatgccttggaaactgctatattgaagatgaatctgcttatgggacattccatgtaggacttgggcgtaatattgctcttggaggtattcagaacgccaaagggcattttgatctggtatgtatggaaccggatatctacacggacaaccgacagattatgcagcaggggaaggttattatcccggagcctgtgttatactaagagatataaaggaggaaattaacatgaaggttttattaacaggatttgatccatttggaggagaaagcgtaaacccggcattcgaggcaatcaagcttcttccgtcaacaattgcgggggcagagatcgtatatgtagagatccctacagaattcaagaaaagtgcaccggcagttgaagcggcaatcaaagaacataacccggatatagtgatcaatgtaggtcaggcaggcggacgttcctgcgtcactgtagaaaaagtaggaatcaaccttgcagatgcccggattccggacaatgcaggtgaccagccacttgatgagccacttcaggcagacggtccaaccggatactttgcaacaattccggtaaatgcaatggttcagaatgtacgtgctcacggacttccatgccatgtatctttcacggcaggaacctacgtatgcaactgtgtaatgtacaatgtactgcatatgtgtgcaaccaaatacactaacatccgtgccggatttatccatgtaccatatgcttgcgatcaggttgtagataaggcgaacggaatggcaagtatgccgcttgagacaatcgcaaagtctctggagtattgtgttgaagctgtagtgaataatacagaagctgtaaaagaggttatgggaactactcactagttttatgaaagaaaaaagtaccgctgtgtcagaatgaagctgatggtatgctccccgtcaagaggacaataaaaaataataaatttttgtatcgtcagccatgctatggctggcgatattttatgctgcttttgtatattgctcatgatatttcattggtgtcattacatgcagtttcctttgaagtcgttggttgttgtagtaatctatgtaattagctatcgcagtaatcaaagagcttctgtcattaaaacgctgtttataatacatttctcgttttagaattccccaaaacccttccattggtccattgtcaatacagtgggcaactctagacatactctgcttcatatgatgtttttttaatctagtataaaactgtgcgcttgtatattgaaagcctcgatcagaatgaactaatgggtgtgcatctggctcctgacgaacagcctcatcaaacgtgtccataactaatggattatcattatgatcgctgattttaaaggaaacaatccttctatcatataaatctaaaatagcactcagataaactttatgaacttctattccgttgtagtatttaaattcagaaacatctgtaagccacttttcattcggtttttcggcgtgaaattcacggtgtaaatagttttttgctatgtgatcaggatttctgtctcctctggtacaactcttaggtttccatttaatatttgattttatatcgtatttcctacaaatacgaagtactcgtttatcattcacatgaattcctttatgtccatctaattcatcacgaatcctccggtatcccatatctggatgctggtgatgaatcctttggatttcagtggatagtctttcgtttcgaagttcattattacttttcggatattttccccagcggtaatacgcagaacgtgtaacattaagatatttacaaagtctatctatgggataatgcttagtagacgatagtttttggatggcttcatattcggctaaccgatggattaaagatagcgacccctcctttccagttctctgactttttttaacagatcattctccatttgtaggtctagatttcttctttccagttcagctatcttgtcacgtagctcttcttcaggtgttctgcttggaagagaagctatacgacgtccacgtctgtcttccagacccgcttgacccatcttttcgtatcgtattacccaattgcgaacttgttgataggaacaatcatatttgagtgccattgcaccataattcttatcatttgcaagacaatctgttactatttttaatctctcatcaagtgtagtgttctttgcctttttcatgtaagcacctccagtggatgtttttaatattccaccagaattatacaccttaatccaatcggaaagctgtctgtgtgaacgaattccgtattttgtgcaaatatcctgaagagatccttctccgttaagataatcatttatagcagatatttttaaatcttttgaataagatttgtttttcggttgattgagtaatccagttggtccatcatactgataaatagaaacccaatttcgaatactatgatgatcaactcccaattcttttcctgcttgctgtatgccaatttctcctgcaaggtagcgttcgactatttttactttttctactggttctatcttactctttctgaacatgaaaatacccccatataggacttttatatttcattgtcctatatgagggtagcatatcatgatgcggcggttttttttgtaaaattttattggaaatataatttcatgtcgcttaatgaaaatggacgttcattatatgttaagaaattctattataaagaaaaagaattgatttgtcacgggcagaaatgttatgtataatatgcataaagaaagtcgaagcggaaataagaaaaatgaacaattttatgaacggagagagttttttcaaaaaacaagttgattaagaaggtgaagaaaaaaatctagtggggaaaagattatcgtaaaaatagaatatggatggaaaacaataacagaggcgaaggagaagtgaaatgagtaatttaatggggatgctgacgactatccaaagttatgtatggggacctccgacattgttgctgttgatcggtacagggctttactttacgattaaattgagaggactgcagatcacaaaatttccacgtgcagtaagggccatttttgaaaaagaaagtgggaccggaagcggagaaggagatgtatcggcatttgcaacgctatgtacaacgatggcagcagacataggaacgggaagtattgttggagttgcaacggcgcttcgaattggtggaccgggatcgttattctggatgtggatttcagccatacttggtatggtgacgaaatattcagaaagtcttttagcggtaaaataccgagtgacggacgagaataaccagatggccggcggaccgatgttttatatccaaaatggtatgggagagaggtttatttggcttgcaaaaatcttttctgtgtttggcatatgtacagcattatttggctgcggaacgtttccgcaggtaaatgcgatcacagaatctgtcaatgtgacattccatataccgatcattgtagcaggagtcatcataacagtgcttactgcggttgtaacgatcggaggaattaaaagtatttcaaaggttgctgaaattgtggtgccgattatggcgcttacttttcttggaggctcggtagtggcgctggtgatcaaccgggcggcagtaccggatgcttttaagaccatttttacctgtgcatttgcaaaagaatcggtaatcggaggaactgcaggaacaggtgtcattacgtttatgacggttatgagaaccgggattgccagaggtgtctatacaaatgaggcaggacttggaagttcaccgatcgtggcagcagcggcgaagacgaattccggtgtaagacagggccttctttccatgacaagtgtgtttgttactacgattctgacctgttccatgacaggactagttatcatcagcagcgggttgatggacagttcggatatgaacggaagcacgcttgttacagctgcatataacatgtgtctgccgcacaatataggcatgtatctgatcgcagtaggaatcatgttctttgcatttaccaccattttggggtggaattattatggagaacgctgcctggtttatctaaccggcacaacgaaatggatcaaaccatataagatcatctacattgcagcaattgcactggcaccgtttttatcgctggaaccaatctggctcctggcagatatcacgaatgcgttgatgattattccgaacctgatcgcaatcattgcacttagaaaagtgatcattggagaaacaaaactgtatttttcaaaacaaaatgaagaaaaaatgtctgctgcggtaaaagcagtggagtaagaaaagaaaccgtcgcattggaaatgagatctgatgcggcggtatttttgcgttagaggataaataaggttgtgacaccaacgccccaaaaagaaagttaacacgattcccgctttcaggggttcatcggaatgttttgccgaggggaaccggagtatatatatttggaaatccgccgcccaccaacctataaaattttccccccaccagttggaaatccccctcatttctgctaaaatggaacacagagaaaaggagcgaacacaatatgaattttgcgcatttgcacgtccacacggaatacagccttctggacggttcgaataaaattaaagaatatgttgccagagtcaaagaactggggatgacagcggctgcgatcacagaccacggtgtcatgtatggcgtcattgacttctacagagccgcaagagcggcaggaatcaatcctgtactgggatgtgaagtctatgtggcaccgggatccagattcgataaaacagccgtaggacgcgatgaggaccgatattatcacctggtacttcttgccgagaataatacaggatacgccaatctgatgaagatcgtgtcacgtgcatttacggaaggttactattataagccaagagtagattatgagcttctggagacctatcacgaaggaatcattgccctcagtgcatgtcttgccggagaggtacagagaaacctggcgagagggatgtatgaagaaggaaaaaaagctgcgcttcattatgaacagatttttgggaaaggcaactttttcctggaactgcaggatcatgggatcccggaacagcgcaccgttaaccagcagttgatgcgtctgtcgcaggagattggaatcgaccttgtggcgacaaatgacgtgcattatacttacgcagaagatgaaaagccacatgatatcctgctttgccttcagacagggaaaaagctcgcagacgaggatcggatgcgctatgaaggcggacagtactacgtgaagtccaaagaagagatggcagcacttttcccatatgcaccggaggcgctggaaaatacacagaagattgcagacagatgccatgtagagattgaatttggtgtgacaaagcttccgaaattcgatgtgccggaaggatttacctcatgggaatatttgaataagctctgttttgacggactaaaaagacgatatggagaagacccggatccagcccttgtggagcgcctgaattatgaattgggcgttatcaaaagcatgggttacgtggattacttccttattgtatgggatttcattcattttgcaaaaagcaacggaatcatggttggacctgggcgtggatctgcggcaggaagcattgtggcgtacacacttgcgatcaccaatatcgatccgatccggtatcagctgctgttcgagcgttttctgaatccggaacgtgtgtccatgcccgatatcgacgtggacttctgctttgaaagaaggcaggaagtcattgattatgttgtgcgtaaatacggcaaagaccgggtagtgcagatcgtaacctttggtacactgcaggcgcgcggggtgctgcgggatgtgggaagagttatggatcttccgtatgcttttgtggattcaattgcaaagatgattccgaaagaactgaatattacactggataaatccctgaagatgaaccatgagctgaagaagctctatgatgaagacccacaggtaaaagagctgatcgatatgtcaaagagactggaaggtctgccacggcatacatccatgcatgccgcgggagtcgtgatcagccagaaggatgtggatgaatatgttccgctggcacttggagcggacaacaatgtagtcacacagtttaccatgaccacgctggaagaactgggacttctgaaaatggatttccttggacttcgtaccctgaccgtcatccaggatgcgatcagactggttgaaaaaagtaccggtgtgaagctggtaacagaaaaattaaattataatgataaagcagtgcttgactatatcggaaccggcaagacggacggcattttccagatagaaagtgcagggatgaagagcttcatgaaggaacttcgtccacagagtctggaagatattatcgccggaatttctctttaccgaccaggtccgatggatttcattccacagtatatcaaaggaaagaaccatccggagctgattacttacgaatgcccgcagttaaagccgatcctggcaccgacctatggctgcattgtataccaggaacaggttatgcagattgtgcgtgaccttgccggatattcacttgggcgaagcgaccttgtacgccgtgccatgagtaagaaaaagggcgacgtgatgcagagagagcgtcagaattttgtatatggtaatgaagaagaaggcattccgggttgtgtcaaaaatggaatcgatgaaaaggttgcgaataagatctatgatgaaatgatcgattttgcaaagtatgcgttcaacaaatcacatgcggcagcgtatgcggttgtctcataccagacagcgtatctgaaatattattatccggtagaatatatggcagcgcttatgacttctgtcatcgacaatccgggaaaggttgccgaatacatttacacttgccgacagatgggaatttctatcctgccgccggatatcaatcgtggggttggtgatttttctgtagataacggtaatatccgttacggacttgcggcgatcaagggggttggaagaccggtgatcgagcagatcatccgggacagagaagagcatggcacgtttcgtgatctgaaggattttctggaacggctttccggtaaggaagtcaataaacgtgcggtagaaaactttatcaaatccggcgcatttgacagtctgaaagggaccagaaagcagtttatgatcatttatgtacagatcatggatcaggtagcacagaacaagaaaaattcgcttgccggacagatgtcgctctttgatattgtagatgacgaacagaaaaaagaatttgaggtcacgcttccggatgtgggagaataccagaaggaaacgatgcttgcatttgaaaaagaagtactcggcgtgtatatcagcggacatccattggaagaatatgaagagaaatggcgcaagagtatttccgcaacgacattggattttcagcttgatgaagagaccggacggacaaaagtgcgtgacgggtcaagggagatcatcggtggtatgatcacatcgaagacgatcaaatatacaaagaagaatcaaacgatggcatttattaccgtagaggatcttcttggaacggtagaggttgtcattttcccgcagagctatgagaaaagccagcagtatctgcaggaggacagcaaagtatttgtgcggggacgtgtatcggaagaagatgataatgcaagtaagctgatctgtgaagaggtgattccgtttgatatgacgaaaaaagaactgtggatccagtatgccgacaaacagagttaccttcaagatgagcagaatctgttccggatgctcgcggaaagtgagggtgaagaccaggttgtaatcttctgcaaagcggagagagcggtaaaaagactgcctaaaaacgcaaatatccaggtagaacctggaattttgagcagattgacgaattattttggagaagattgtgtaaaagtaatagaaaaacccattgaaatgaaggggtgaatattatacaataacgtgtgaattgagataaattaagcaaaaggatagtaaagttacaaagtagaagagacggaggagacatatcatggcagaaaaagtaatcagaactatcggcgtattgaccagtggaggagacgcaccgggaatgaacgctgcaatccgtgcagttgtaagaaccgcattgggaaaaggactgaaggtaagaggaatcagaagaggttattcaggacttcttaacgaggaaattattgatttaagtgccagagatgtatcagacacgatccagagaggtggaacgattcttctgacagcccgttgcgaggaaatgcgtacaccagaaggacagcagaaagcagcagcaatctgtaagaaatatggaattgacggtctggtagttatcggaggagacggttccttcaagggagcacagaaattatctgattttggagtaaatacaatcggacttccgggaacgatcgatcttgatatcgcatgtacagaatacacaatcggattcgatacagcggttaatacagcgatggaagcaattgacaaagtacgtgatacatctacatcacatgaaagatgtagtgttatcgaagttatgggacgtgatgcgggataccttgcactgtggtgcggtattgccaatggagcagagaagattcttcttcctgaggaacatgactacgatgaagcaaagatcattgcagacatcaaagaaagcagaaaacgcggtaaaaagcattacattatcatcaatgccgaaggtatcggtgattctatgaatatggcaaagagaatcgaaaaagagacgggtatggagacacgtgctactattcttggtcatatgcagcgtggaggaagcccgacagcaaaagacagagtttatgcatctatcatgggatctcttgctgtagatcttcttcttgaaggaaagacaaaccgtgtagtagggtacaaacatggcgagtatattgattttgatatcaacgaagcactggcaatgcagaaaggaattccggagtaccagtatgatatcgcaaaacagcttgccatctaataacagacagattggatgacgtgtatgacacaggatgtattattgacgatttccggactgcatgatatggcatttgcaaatccggaagaaaatgaagagaatgagccgattgaggtgatcactccggcgagctattactggaagaacggaaagcattatattctttatgatgaagtaatggaagggattccgggggtggttaagaataagatcaagatcaccggtgaagattcgatggagatcatgaagagcggaattacgaatgcacatatggtatttgagaagaatcagatgaatgtcacatattatgatacaccgtatgggcagcttcatgttggaattcatacacggaagctggatgtgaatgtggatgatgagcgaattgatattgctgtggagtacgggcttgatgtgaatcatgaagcgacggcagactgccggatcgcaatgagcataagaccgaaagcacaggcagaggaagcaatttcaggaaaataaaacaaaaagggtaaatgattcaatcagctcagaatcatttacccttttttgttacttgttccgcagtcttgcccagaatccttttttcttaggtggagtctcaagagaacctctgactccttttactgcagtgatgtaaataccgcttacggttgcttttacttcttttttgactggaataagatcatagatgcttgcatcacacatcagagtcatgatctttggtccgacttttgccttgactacaggtacctttgaacgacgaagatacttaggtgtattctcaagaacaactgacgggaaaccggcatctttaagcttcatcttacctttgtcgataaccaggatgttgacctgctgtgcagcagctgcaatcatctcttcctgttctgcctgctttttctgcgctttcttaccgaggaaatacagaacaaccagggcgataagcagtacggcaagaattaccagtaatacgatcgttatcttactcacgggttttcctcctcaaatcatatttacacatagcttattgtagcattgtttgtagacaagtgcaagtaatttgaagtttttggcggctttttgaacgtaatggaaaatctgaaataaatgtgaattttgggaaatcccttttcaatgacggattatgtgttataatcatatgtagcgctctgatgtgggtgatttggacagtcagagagaatgaagatataagaggtgtaaaagaaaatgaaaaagaaattagcagtactggcagcaggtatctgtgcattgtcattatttcttaccggatgctccggtgagatttccaatgattatgttacgattacaaaatataaaggtgtggagattgataaagtagatgcggatgcggtatcggataatgatgtagaagcacagatcaacagtgtacttcagtctaaatcaactacaacagaagttacagaccgtgcagcacaaaccggagatacggtaacgatcgactacgaaggaaagaaagatggtgtggcatttgatggtggaacagcgacagatgcacagcttacattaggaagtggtcagtttattgacggatttgaggatggcgttgtcggacacaatattggcgatacttttgatctgaatctgactttcccggagaactatggaaatgaagatcttgcaggtcaggcagttgtatttaccgttacactgaagggaatcagccagaccgatgtaccggaacttaccgatgaatttgtacagagtgtttctgatacttccaagacggtggaagagtacaaaaaggaaattaaaaaatctctgaaaaaaaacggcaaagaaaaccagcagaatacaatcaaggaaaatgcatggaaagcagtacttgagaacacaactgtgaacaagtatccgaagaaggatctgaagaatatgatcagttcgatcaagacacagtataagaatatggcatcttattataaccttgattttgcagatttccttaaacaatatatgaatatggatgaggaaacttttaattcaaaggcaacccaggctgcaaaggatcaggtaaaggccaaccttgcggcagatctgatcattgagaaagcaaagatcgatgtgtcagataagacacttgagaagaagtataaggagtatgcaaaggcttacggatacgaagatgtagatgcactcaaaaaagcactggaagatgctggaaacctggagaatctggagaagacagcaagactggatatcgtagaagactgggtagcagacaactgcaagcaggtgaaaagtacttcatctgacagcagcaaaagcggttcaaacagtacaggaagtaccggcagcacagaaaatacaaaatagatataagcaaacattcaaaaggcggagaataaaatctccgtcttttttcttcctgaagggaatggtatgatatagaaagtaattgtttttacaaaatgaaatatactacaggaggacaagatgaaagcagtactttttgatatggatggcatcctgatcgatacagagaaatatctgacagtatacaaacaaaaggcaatgcgggaggcgggataccggttgaatctggaaacggcatacaaattccgcagctgtgcatccgtatttgcaagagagcagatgaagggaatttttggagaggatttcccatacgatgagctcagacggcgcagacaggagctgatgagtgatcatattgcgcgtttcggaattgagaagaaaccgtatgtggaagagacgatcaaggagctgaaaagacgtggttatcagacggcagtcgtgacggctacagcggaagacagggctgtgcgttatctggaaatggtcggatttaaagagctgtttgatgaaatcatcagtgcatctatggtgaaattgggaaaaccgagaccggatgtgtatctctatgcctgtgagaagatcgggcggaagcctgaagagtgcatggcggtcgaagattcatcgaacggggtaaatgcggcttaccaggcgggttgccatgtgacgatggttccggatctgacacctgcagacgaagaggtcaaaaagatggcagatcatgtcgttccagacctgcgaggacttctggaatatctgaaataacccctgaaaatgaggagagccgatatccggtttcccgaatatcggcgtttatgaaaaagaaaaattttattatgtgaaaaggtttatttccttttgacaattattagtatactcgtatcttgtgaaaaaagtgtgtttataatttgaaagaattatgaacgtttgtgaacatagtatacatatattctgaagggaccgcagacagcagagtctgcagcccgacaaaagggatttaatctgttccgggaagcatcgaccggacgaaaagcgaaaacaattcccgcatacatggagaagtaaaaaacatggattccggatgccactgaacgccaagtgcaaaaggctgtccttcgatttcaattgcctcaactgtgccatcagaagtgtgtgcacatgcatggacattttttccgagcagatgaacggactgatggtggaaactattggtatacagagtgtctccggtcagttcatgaagatggctgtctttggcgatgaaaatctggtgccacatatcgctgcggttctgtgaggtctgcatatgcagaaaaggatctccgggctgacaggaaagatcctggtagatacttccgccacaggcggcgttgagcacctgcataccccggcagatgccgattaccggaagatgacgttttaagatttcctctgcaaaatgaatctggaaaagatctacagaaagattggtctgtcctacacctggaagtggatcttcattgaagagaaatggtgtaaaatcacctcctccggggagcagaaatccatcgcatatgtcaagataagaattgatcgggaagtcctgaggaagaatcggtatcagcagggggattcctccggaaatgcggactgcccgcacataggtatcggttacaaactggtttttgccgtcgaagccacagcataagattccaacaactggtttcatatttacaatcctcctctttatcagataaatcagttgttacaaaatatgtggagtctgtatgaaatatgtattataataaaaaaagcaacatgccagatggcaggaaaggagttcctatgaaactggttattccggaatataaaacattagaacttgatacgatatttttagatatgaacgggacgatcgctgtggacggcgtgatcccgccgagtgtgaaggaacgtcttatcgcactttcagagcagttccgaatttatgtactgactgcagatacgcatggaaatgcgaaagcgcagtgcgaagggcttccggtgatcctggagacatttccgacaggtaatgcaaaggagtataaaagggaattggtaaaagcgaccggtgcaaaacgctgtgtggcaatcggtaatggcagaaacgatgagtggatgctgaaagaggcggcgctttccatcgctgttatggaccgggaaggggtctatgggaaattattgaaaaatgcggatctctgcgtcagatctatgcaggatggactggatcttctgctctatccaggtcggatcattgcaggactccgtggataatatttgcagaagaatacgtaagagtatgtggaaggagaaaagatgcgtcaggctatagtgacattgaaaaagggtgagggacgtctgctgaaatcaggcggcgcctggatattcgataatgaaattgattcgattatgggagaatttgagaatggtgatattgtgatcgtccatgattttgacgggtacggaatgggaagaggatttatcaatatgaattctaagatccggatccgtatgatgacaagaaagcaggatcaggagatcgatcatgcatttctggaaatgcgggtgagagatgcgtgggaataccggaaaaagacagtagatacatcaagctgccgtgtgattttcggagaagcggattttcttcccggactggtgatcgataaattctcagatgtgttggttgtagagtctcttgcactcggaattgaccggatgaaagaagaaatcgtggacattctgaaagcggtactttcagaagatggaattacgatccgtggcgtgtatgaacgaagcgatgcaaaggttcgtcagaatgaaggcatggagagagtcaaaggctttatcggtgaagaatttgataccaaagttgagattgtggaaaatggtgtcagatatatggttgatgtcaaagacggacagaagacaggatttttcctggatcagaaatacaatcgtctggcaatccagagactttgcaaggatgcagaggtgctggactgcttcacgcacacaggctcttttgcgctgaatgcagggattgcaggggcaaagcatgtgacaggtgtagatgcttcagaacttggtatagaacaggcaagagagaacgcaagactcaatggattagaggatagagttgaatttgtctgtgcagatgtatttgacctgcttccaaagctggaagaagaaggaaagcagtatgatgtggtaatcctggatccacctgcatttaccaaatcccgtaagacgatcaagaatgcgacaaagggatatcgtgagatcaatatgcgcggaatgaagctggtaaaaccaggcggatatctggcaacctgttcctgctcgcattttatggattatgagctttttacgaagacgatccaccaggcagcgcagaatgtgcataagaggatcagacaggtagaataccggacacaggcgccggatcatccgattctgtggtcggcagaagaatcgtattatcttaaattctatgtgttccagatcgtggatgaaaaataaagtgttgtagtagataaaaaaggtatcgaaaatcaaacataaatgattttcgatactttttttactagtgtacatatttcagatttgatattctattcaaactgcgcagccgataatgcaacataatccgcagcatttttataaattgactggatctcttcctcagtaagaggtctttttacttttgccgggcttccgataaccagcattccatccggaataactgtgttctgagtaaccagacttccggcaccgatcaggcaatgctttccaatctttgcaccgtttaaaatcgtacttcccatcccgattagagacgcgtcaccaattgtacagccgtggatcacacagttgtgaccaacagtgacatcatcaccgataacggtcggaaaaccgtaatctacatggacggtactgttatcctggatattactgcgcttgccaatcgtgatagacgattcatcaccgcggacaacggcataatagaacacacttgagtctgcaccgatggtgacatcacctaggatgacggactgactggcaatgtgcgcctgtgatgaaatatttaaagaagacattacagcagattcctttctcgttgtaagattattttttggcttcaacagctttgaccgggtttttggcggctgcttttgtatcctgttccgcttccggctgataaccgttgatattatatttctgctcgtaataatcaaaggtggatacataattgttgtctttcaatttccgtacactcttagtgtattcgtgcatatcgaaattggaagaatccagttccaggattgcaacggcaatgttagaacagtgggctgcaatacgatcatagttggtgagcagatcgttaaatgcaaatccggtgttcagatcacactgcccgttacggagccttttaatatgacgcattttcaaatcgttgcataaaataccgatcagttcgcgaagcggttctactttggcagcatttacaaggtcttcatctacaaatgaattgatcgtgagatcaaggagctcttttaatgcggattcaagaacatgaagctcgtatttggctgcatctgaaaaaatacgtgatttttcatgaagttcctgtgcaacacgggaaatattgactgcatggtcacccagacgttcaaaatcactgatcgtatgaaggaacttggcggtctgtttggactgttccggtgtcaggtcgtgcatattgagctgcatcagataggttcccagtttatcttcgtatttgtcgatcagattttccttttcctgaattttgttgaacttattatctgaaaaatctttcagcagtgcaagggcgcgacggatatttttgtatgctttctttgccattccgttgactgcaagctggctctgtgtgattgccagtggcggataattgaggaaacgttcctcaagaagatcgaaatctgcctgctcttcgttgtcttcatcggtatctttaataaggaagaagacaagcttttcaatcttgccgataaatggagcaagaacaaggatcgtcagaagccggaataccgtattcaaaagtgccacacggaaaggtgacataatttcacccataaatgggaaatgcacgatggcatttacagaatagaatacgatggaccagaaaatcataccaaataaatcgttcagcagatagatcagagcagtacgctttccgttcttgttcgttccgattgaggaaagaagaaccggacatgcggcgccaacgccgatacccattgtgatcggaagtgcagctgcaaaggtgatcgatccggtaatggacagtgcctggaggatacctacagaagcagaagcactctgcaaaactgctgtaaatacgatcccaacaaggattcccataaatggattcgtgaacatggtcagaagtctgacgaaatgcggattctctttcagaggagagacagcaccgctcatggtctgcattccgatcatcaggatcgcaaagccaagcatgatgtcaccgatatcagaatacggttttttcttgataaatgtacggaaaataattccgatgattgctacgattgcagaaattgtagcggttgataaaagctgcgcgattccgctggaaccatcaatgtaggagagacataggatccatccggtgatactggttccgatgttggcacccatgatgataccaattgcctgtgcgaccttcatcataccagagtttacaaatccgactaccataactgtcgttgcagaggatgactgaatgatagcggttacgacagtaccgagcagaagtcctttcagaggagtattggtcagcctgtataaaataagttcaagcttattgccggcaactttcttcagactgtcgcccatcagtgacataccgtataaaaacagggctaccccactgagcaatgacaaaaccattgtaattcccataattttgttttccttttctttaagcattagtttacattttgtcgcaaaaaaaatatcgtacagctactttaaatatgaaaagtctgcatgcagatcacacaaagtgacgctatacgacactcttattatataacaagaaagtttccataggtagactgaaacgatatttttttacactttttttacaaggacttaactttttctatacattcggtagcaaaaagagccgcattttcaaggtctgtgcgtgtcggatgaatcattgcttcgtcaaaattctgtaattgccgtcggatttgctggcaatcgcaatcttttggtgtgttcagcaaggattcatatttttgacggacagcaagcggcattttcccctggcagataaaagaaccgagatagtggttgtcatcttcaagccagatccggacgctggatgcgatctctttgtagtattccgggctgtttccggcaccgcaggttccaaagagagcaacggatttgcccgacagaccggaaaggaagttgccaatctcgaggcggcaggttccgcggtgaacacagaaaccaacaaaataaattttggcttctgggaaatcggtacgttcatgaagatttatcagatctttggacatccccggaagggatgcaaaaatttctgttgctattttttttgtatttcctgtctcactgtcatagacaacaagataatctaacatatagtatttcctcctgtcatttagtggtatgtataaggagaaccgcagaagaatccaccgccgccacagcagagattgcacatgatgttggcaatgcagagcttcacgcagaaatcattgttgatcgttggtgtaccgccatacattgtctgttgtgtacgataccagcttccaccattttcaagacggctgacaagagactgatattgatagttggacggctccagacgaagagcttctttggcgtgctccagggcgaggacattattgcccatgccggaattggcgatagagctgtaatagtaccatctggcagaacggtctttgattcctgaaaggacatttaaagcttctttataatggccactgttcagataattggcggcggcacgcagatgaatatcttcttctgtctcggttgtctgctgattctgattggtatactgaccgtagaaaccgccgaatgaaccaaaaccgccaaaacctccgtatccgcttccggcatcgccataacctctggagcctgttccggtatatccggaagcacccatttctttttcttttataatctgctggtaagcctgttggatttctttgaatttggcttctgcctgatctttatttggattgttgatattggcatccggatgataaatacggcttaatttgcggtaggctttcttgatatcctcatcggaagcatcccgtgaaacgccgagtattgagtaaggatcctgcataattgattattctcctgatcgttagctttttttgataaaagtagtctggcattttggacagcggatctcaattttaccttttccctttgggacacgaatcttctgtttgcagtttggacacttgtaaatgtggtgtgtcttgcgctgcgctgccatatacttctgttttgcaaaaaatccacggatctttgaagtgtgctggagaaatttctggttttccagtgcacgcttgtaggtctgacgtgaaaacatgcgatagtaagagtatatcacgaatgcccacccaattacataaaaaatacgaaaatggaagatgcttgtgatcagcatcagaattacgccgctccataagagaaatttgccgaaggtatctactccgtaccttccatacataaaacgcatcagtttttctttcataatgttcacccaatcttttttatttatagaatatgatgataccaggggcaaaaggccagaaagcacgtagcaatctggtatcaaaggggtcaaaataccttttgaccacaacatcatatgatactatacgatggtttacattgtacgcctgcacacacaaaaatcaataaactctctattaaaaaactctaaaaagtatgttatactgctgatatcgtgaaaatatggaagaaaataggacttctgagattacatggcaatggagcaatctgggaacatcatatataaaaagcagaggaggaaattatgggacggaaaggacatggtcggtatggaaagcattccaggcgtgatcggcgcaagaaaaaaggtggaatcatcagtacggtcattttgatcgttgcaatctgtgtgtttgcattttctgcctttcagctgtataaaatctttaacggatatcacaaaggggaaagtgagtatgatgatctggtaaagcttgcggttacggaagataagggggaacaggagaacgggacggacgatcaggatggaagcagattttccgtggattttgatgcactcagacagatcaatccggatgtggttgcatggatccgttttgatgaaccggcggtgatcaattatccggttgtgcaaggaagtgataattcagaatatctgagtaagacattcaaaggatatgacaataccgtaggaacgatttttgtaaatgcttataatcatgcggattttaatgacagaaacacgatcatttacggacattatatgtataatggaacgatgtttaatgagctggagcagtatcacgaaaaaagtttctgggaaaaatacccttccttctatatttatacaccggatggcaatgtggctacttatcagatttattctgttggagtggtaaaagatacttccgaaggctatacatatcagttcgcagatgatgcggcgtttgcatccttccttgaagcaacgaaggcgtcttctttgtatgatacaggtgtggaagtgggaaatgattcgcagatcgtgacgttgtccacctgtacacgggagggaaatgatgacagaacgatcgtacacggtgtcagggtaaatgtacagccggcaggagaataaaagaggagtaaagcgatgacagcagaagcaaaatttgaagtcggagatgtgatccggatgaaaaaaccgcatccgtgcggaagctcagagtgggagatcctgagagtaggggcggattttcgtctgaaatgtcagggatgcggacaccaggtaatggtaccgcgcagactggttgaaaaaaatacaaaagaaataagaaaaaaggcttgaaacaaagcttgaattatgatatcataccaacttgtgatatattatttatccttgttcccggcggatccgggagccaaaagaccataaggaggtgcaggacatgagcaaatatgaattagcagttgttgtcagcgcaaaactcgaagacgacgccagagcagaagtaatcgaaaaggtgaaagcacttgttacacgtttcggtggtaacattactgacgttgacgaatggggaaagaagagattagcttacgaaatccagaagatgaaagaagcttactactacttcattcactttgaatctgaaacaacaacaccaggcgaaatcgaagaaagaattcgtatcatggatggtgtaatcagatatttatgcgtgaaacaggaagcttagaaagaggcaacgtatgaataaagtagttttaatgggacgtctgacaagagatcctgaagtgagatattcacaaggtgagaacgctctcgctattgcaagatatacattagctgtagaccgcagattcaagcgtgacggagaacagaccgcagattttattaactgtgttgtgttcggaaagagtgctgaatttacagaacgttatttccgtcagggaatgcgcgtagtggtttgcggaagaatccagaccggaagctataccaacagggatggtgtaaaggtctatacaacagaagttgttgttgaggaacaggaattcgcagaaagtaagaatgctagcagtgctaatacacagtcttatcaggcagccccggcaccggcgccaagcgctgatgcaggtgacggtttcatgaacattccagacggaattgatgaggagttaccgtttaattaaggttgaaaggagatgtgtacaatggcattcgaaaaaggaaacagaccggattctccaatgaagagaagaggcggacgcagaagaaaaaaagtttgtgtattctgtggtaaagaaaacaacgaaatcgattacaaagatacagcaaaattaaagaaatatgtttctgagagaggaaaaatccttccgagaagaatcacaggaaactgtgcaaaacatcagagagctcttacagtagcaatcaagagagcaagacatatcgctttaatgccatacgttcaggattaatcgaatatgatcagaacaggatttccgttttggaagtcctgttttttttactgtttttctgtctggcagacgattgaaaaaggagtcatttggggttagaataagaaagagaaagttttgaaatctaaaaaagaattggagaatcaattatgaaaaaaccagttttagtaattatggcagcaggaatgggaagccgttatggcggacttaaacagatcgatccagttgataaagagggacacatcattatggatttttccctgtttgatgcaaaaagagccggatttgagaaggttatttttattataaagaaagaaaatgaagacagtttcagagaagcagtaggaaaccgtatggcaaaatatatggaggtttcttatgtatttcaggatatcaacaacattccggaaggttttgaagttccggaaggcagagtgaaaccgtggggaaccggacatgcagtcctcagctgcattgatgagatcgacgggccatttgctgttatcaatgcagatgattattatggaagacatgcgtttgaagcaatttataattatctgtctgagcatgaggatgatgataagtatcgttatgcgatggtcggatatcttctgaagaatacagtaacagacaatggtcatgtggcaagaggaatctgtacgaccaatgaagaaggggaactggtaaatattaccgaaagaacccgcattgagaagcgtgacggtaagattgcgtttaccgaaaatgatggcgaaacctgggaaaatttaccagaggatacactggtttccatgaatatgtggggatttacgagaagcatactggacgagctgaaagcagaatttccacagttcctgaagaaaggacttactgaaaatccgatgaagtgtgaatatttcctgccggcagtcgtaagcaatcttctggaggcagaccgcgcaacagcagcggttcttccgtcggcagataaatggtacggcgtaacttataaagaagacaaaccggttgtcgtagaagcgatccgcaatctgaaaaaagaaggtctttatccggaaaatctctgggaagagtaggaatgtgttgaaatttagtaaatagttcatttgatttactaaaaaatataaataatttagtaaaaacacttccatataggcaggatgtgtgctatagtgtgtaaagaaaagtaaatgattctaatttcaggaggaaaaaatcatggcaattttagtaacaggcggagccggatttatcggcagtcacacatgtgtagagatgctgaatgcaggatatgaagttattgtagtagataatctttgcaatgcttctgaagaagcaatcagacgtgtagagaagatcaccggtaagaacgttacattttataaagcagatatcagagataaagaagcactggatcagatttttgacaaagaaagtgtagaatgtgtcattcatttcgcaggacttaaagcagtcggagaatctgttgcaaagccacttgaatattatcagaacaatattgcaggaacacttacactttgtgatgttatgcgtaaccataatgtgaagaacatcatcttcagttcttcagcaacggtatatggtgatccggcatttatcccgattacagaagaatgcccgaagggaacctgtacgaatccttatggatggacaaaatggatgcttgaacagatcctgacagacctgcataaggcagatccggagtggaatgttgttcttcttcgttacttcaatccgatcggcgcacatgagagcggactgatgggagaagatccgaagggtatcccgaacaacctgcttccatatattgcacaggttgcaatcggtaagctggaatgcctgggggtatttggtgatgattatgatacaccggacggaacaggtgtgagagactacatccatgtggttgaccttgcaattggacacgtaaaggcgctgaagaagatccaggaaaaatcaggcgtaagcatttataatcttggaaccggagtgggatattcagtactggatgtattgcatgcatttgaaaaagcatgtggaaaagagatcccttaccagatcaagccaagaagagccggagatatcgcaacatgctactgtaatgcagaaaaagcaaagaacgagctcggatgggttgcagaacgcggaatcgacaagatgtgtgaggattcatggagatggcagacaatgaatccgaatggatacgaagcttaataaaagaaagaaaaatgtgtcagggtgtacgttccctggccgtgaagtaataaaataaatgcgaaaagaggttgaaaaacccttgccgcatttatttttttgtaaaaatataggaatttctgacgatgcggcggggtaaatcaacccttccgcattattttttgccacatacggagaagggagagtgagaacatgagcaaaaagccgtatacaagtttgacgtttgacaagagacggatcatagagagcatgacgaaagaaaagcagccgccgcagcggatcgcagaagcgacgggcgttcatgtggcaactatttacagagaattaaagcgcggccagacagaagacgggtacagcgcgttaaaggctcaatgtgaaattttaagataacaccggctgacagatcggccattttataaaggttgtattttcggagtaggtcaacaggttttcggcccggtttttaaggtgaaagcggggcagcggtggagagcacgaacgctttaaaaggctccatgttggacaacaagttttttatttttaaggtgaaaatagataaggtttggacgttcccgacaaaaagacgcccgccggaccgcgtgaaagccggttgacaaaaacacgcccgaaaaatacagcccttataaaatggccgatcatatttggcagtaggcagcaggacaaagaaaggagatctgagaatatgggtttggcagacgtattttcaagagaagatcgggtggaagtcactttttcggacttcttcaacattgtaaagcaggcggcgcagaaagaaaacctgatgaatggcgttaattgcaacgtgccgtatgagtacatacgggaaatggtgacggggcagaaagaggaaccgcaggaagtagaagcactggaagccgcgatcgagatcgaaacggacgaatacacggtaattacggaagcaatacggcgccttctgaaagagtgggacaacgaagaaagcgtttcggagattgcaagccgcattgtcgggatcgtggatgaactgatgaaagcccggatttgcgaaatcattttaaagaacgcggagcgtctggaggaaaaggacgcagaggaagaacggcaggcagcagaggaagaaccggcagcaggcgcaggcaagccacacattcttttgacggaagaaaaggaagcatgaaagcgatcatgaaatatcccggttcaaagtggggaacggctgaatggatcatttcacatttcccgaaacatcatagctatgttgaaccgttcttcggttccggcggcgtgttcttcaacaaaccgcgatcggatattgaaaccataaacgatcttgacggtgacgtggtgaaccttttccggtggataaagaacgatcctgaaaagttggcgcatgaaatctatttcacaccgtattcgcgggaagtatacgaagcagcctaccagaaagagccggaagacagcttggaaaaggcggttttgttctatgtgcgtctgaatatgggccacgggttcagaactacgggcgagaaggtcgggtggaaagcagacattcaggggcgcgaaaaagcatacagcgccgcggagtggtgcaagataccggaaaagatcatggaagccgcggaacggttgcgcggcgtacagatagagaaccggccggccgtggaagtaataaaacggttcaattatgaaaatgtgctgatttattgcgatccgccttatgttctttctacacgccgcgggaagcagtaccggcacgaaatgagcgacacggatcacgccgagttattggaaacacttttgaagcacaaaggcccggtggttatttccggctatgcttcggatttatacaacgatatgttgaaggattggcagcgggaagaacggatcaattacgcgcagaacgcgcacagacgccatgaatttatatggtataaccggcaagcgccggaaacacagttgacattattttaaaaaaggagatcgaccatgagaaaagaagactttgtaatggcattacttgaagcgttgtcacagcaggcagcaggcccgcgggggggggggggaagggcagagcatgaacggaaaggacggaaaagaaccggaagcggtattcattgacgaattattgaagacggccggaaacccggaagaattttcacagaggatccgggaaggaaaaacgttcaaactgaaagaaaaggccgggatccatattatcagcttggacacggacaagccgccgatcattcagataacgggagaatttggcgcacttagtaaaatgttaagtttcgctatgtccgtgatgattgaaaaagcggtggatgataccggggaccggacagagattgaaaaacatttccgagagatcacagaattagcgatcatgacatccagaatataaagaagggagatcagaacatggaaaaaatgaatttgccgttgcagcagtttttaacattagtcggaccggcgcaggcgttggagattatcgaagaagacgacacggaatcggtattcaccggaaaggcagcgaagatccgggaccatgaagaattgctgacgcgcgaggtaaagcatattcagacaggaacaaaaaggcgatacgaacaggggaaaaaaccgtttgaaccgattttcaagatctggatttattaggacggcgccatgattacggtaagagaatttttgaagacgctgaccgggccggatcgaataaagatcgtaaaagacaaagaaatattatttgtcgggtaccgcgcagacggaaaagagattccgccggagtgtctggacgctgaaatgaaattgtttcggtcagaaccagagatcagacacagagaatggaaaaagcgcggccttatgccaccattggagccggaccagacgccggatttcaagttttcagatctggaaatgaagctgtattacaaaatctgtatttaggacggtaaaaaaatgttggaattagtaccaataagcctaaaagaagcaaatgcttttgtggaaagataccacagacatcataaaccggtcaccggacacaaattttcagttgcagcagcagaaaacggagaaattgtgggagttgctattgtagggcggccggtcagccgctatcttgatgatggttggacgttagaagtcaatcgcttatgcacagacggaacgcgaaacgcctgcagttttctttatgcggcagcgtggcgggccactcgaaatatgggatataaaaagctaattacatatatccttgataccgaaaaggggacaagtttaaaagcggcagggtggaaatgtgtcggagaagctgatgggaagcgttggacgggggtgcgacggccggaagtggaactttatccggcgtaaatgaaattaaaatttgaaatcagtatatgaaaggagatctaaccaatggcacagttaaacaaagcattgttcagcagcgctaaggaagattgggaaacgccacaggacttcttcgacgcactggatcaggaatttcacttcaatttagatccgtgtgcggatgatacgaacgcgaagtgtgcggagtattacacgaaggagcaaaacggacttttgaaggattgggggggcgttcggtcttttgcaatccaccatacggccgcacgtcaacgggcgaatggatcaaaaagtgttacgaagaagcacagaagccgggaacggtggttgttgcgctcattcccgcgcgtactgacacaagattttttcacgaatacatataccataaagcggaaattcgcttcgtaaaagggcggcttcacttcggcgggtgcaaagacgccgcgccgttcccttctatggtggttgtattcagaaaggaaacagagaatgaagacaagcaggcagcaggagaacacgcggcaccaggagccgcagaaaccgaagccacgacgaaggaagattgatccgaaaaccgggctgacagtatttgaaccgaacacggtttattttagtgactatctgttaaattatatcggtgcgaagtggtccgcaatcaaaaacagcctttacgacgccggttatcaggtagcagaagtgagccggtaccgcgacgaacttctggacgattttaaaattttatgtctggaacatcatttacacggcattgtgtaggaaggagaacggagcatgagcagcgttataaaacgggatgtatacgggctgatcgacaaggaactggacgcggcgaataaaaaatttccacttttcgccgggagccatgaagccttcgccgttattctggaagaagcagaggaaacccgcgaagaaatggaaaatttagaagctgttttggggaacttctggaccggagtaaaagagaaccacgaaccggaagcccttcacgaagaattgacggcaatttacaagacaagcattgatttagccgtggaagcgatacaaacggcagctatggcccgcaaggggattttaagcagtattgaacttctgtcaatagatcagtgtttaacagatgaagaaaggggagttttacagtgacgcggcgcgacatggacaggcaaagagaatataaagcggcgttattactggccgtatttggtgccgttcttgtaacgatccttatgatccttgtattcgtggagagttggcagcaggacgccgccctccagacgcagcaggaaacagacgccacaccggagaagctgacaatagaaaacccggatccatgcgataccggaagcattgtcatatatgcaaacggcggcgtttattcgttttacggttcctttgatattgagaatgacgggaaggacggaaacgaaatcataatgacgcttgacggctacatggaagcaggctatccacacggagaaccggcggcgccggagatttacggaccataggagaaggaagcatggatttaaagggaaatcagataatagccgtcgattttgacgggacattgtgcaagcaggcgtggccggaaatcggagaagcaaacgaacgcctgatttgccacctgaaagaaaggcaggcagaaggcgcccgcctgattttgtggacaaaccgggaaggggatttactggaagcggcggtggagtggtgcaaagagtacgggctgaccttcgacaccataaacgcgaatttgccggaaatgatcgcgctttatcataacgattgccggaagatcaacgccgacatttatattgatgataaagcagtaaacccgataccataccggcaggccgccgggatcgtgaatttcaatccatacgaaaacccggtagacaaagcaggatttgaaagaaggagatcgaaccatgagcatatttaaaaggagagccacaacggagaattacaaggaatttagaagggtattcggccagatccgaaaaatcagcacacaaggaaccatgcaggaagtagacatgacggccggttatcttttcggcgtagtggtggagagggccgccgccggaaggctgacgcgttcacagcgggaagcgttattggaaatgatcgaagcaaagcaggaagaacgacggggagaactggaagcggaagacggggaagaagaatatttcggagaattaccgccttataaagtgggatcctgaacagtaaaaaaaccggattgaaaaggcggggaccttcttcaatccggttcattggaaatctaacctagaattattatagcagaaaggcgggaaaagtcaatgttgaaaactcacgaaaagagccgttttgaagtaatgaacggaaatcagattgtgaaaacaagccggatcgtggttcagattgcagaagaaaaactgtataccaatggttcaggaatggcgtgttttctttgcgaaaccgtggatccggcagattatgaccgggaaacggcagaggggcgggcactcgaagcgcagaaatgcctgcaggacgaaatcgcaagccacaaagaggaaatggacgaagcggaagcaaagatcgccgcactggaagaaatgttggcgcaggcgcgagacgaacgggacaaggccagagaagacgccagacagaaagaagaagaaaacacggcgttctatggcgcacttgtggagtgtgaacggatcttcggcagcttgccgccggaaatagagcgcctttataaagatgaagcggaaaggggctataaataaaatgtatactttagaacagtttcggaaaattacagaacatcttcccggagattttgagatcaggatcgaagcgtctttcacaccggaagggacagccacggtgccttgtttcgagatcatcacgtcgcagcagtcaaagcagattgttttaatgccgcaggcggtccatgtaagcgacggagaaaccggcctgacggttcagcacgaagaaaggaaggggaagaaatgagccggtattgttctttttgtggaagcacagatcatccgacgaaactttgtccgaaaacatggaacggacaagcgaaccggaaccggcttcattgttcctattgcggaagtagtttacataatacagaatattgcccgaagacttggggcggaccgggaaaccggcgccgcaatcctgacggagaatttttagattaaaccggaagcccgattgtgcaaaaagcgcgatcgggccgttgcggactttcttctatatataaacaaaaccattttccggccgcgtaatgggtattaacaaaccgacgatctctaaatttttctatttttcaggatgtagatcaggaccgggagaaggaaggcggggacagcatgaagaaaaagacgtatgacaattacgattacgaagaagcgtatcagaagcagatcgacacactggaagaatgggagttggaacggctattgaaggaaaagaaggtgaacagcctttaccgaaccaccaccacgaaagcaggaaatcaggttgagatcgacatatacccttcatttgggaagaaggcagacgtgccgcgaaccaaacgaaagcgggaaagcaaaccttcacaaaagaacttgaacgatcggcgggcgcgcagatacctaaatcaattaacggccgcgaattttggatccggggatttatgggggacattcggttatgatgatgagcatttaccggcagacatagaggacgcacaaaggatcttcacgaattttattcgcaggataaatcggaagcgcaagaaagagggaaaagaaaatctgaaatatatctatgtcacggaatacagcgacgatccgaagcggaagatccgttgtcaccaccacattattttttccggggattgtgaccgggacgaaatagaaaaaatgtggaaacatggaacccgcccgcagacaaagcggcttgatccagacagcgacacgcatttgacggggcttgtcacatacataacaaaggatccgaaggggaagaagcgttggagcgcgtcaaagggattgaaaaaaccggaagtcagccggagttattcaaaattcggaaaacggaccgttgagaaaatggccgtggatcgcgattttttggaaaggcagctaaaagcgaaatacccggatcataaattcattgacgcggaagtgaggatcaataacataaatgacggcttttatatatatgcgcgtatggtgcgcgattgaaaggaagtgagaacatgaagaaaatcatagacgggaaaatatacgacacggaaaaagcggaagtgattttttcttttcgccggaaatatacggatccgattatgtggcggaagggccttgtacacgttgaatatgtacccgcacaatatttgaaaacgcagaagggaacgtttttattttactatgagcgccgggaagatctgaaagtggttaaggaagaagaagtaaagaatgtgatcgaaaaactggatcctgatcgctttatggaactttacggagaattagaagaagggtaggtattgaagatgaaccttgcaaacaggaagcgttccgaaaccatggaacaaatagcactttttaattgggccagagcaaacgaaacatttataccggaattaaaattgcttcatcatgtgccaaacgaagggaagcggagcaacgggccagtgatgaaggcggcaggcttaaaacccggcgtcccggatctttgccttccggttgcccgcgggggttttcacgggctttacatcgaaatgaagtttgaagacggaaaaaccacgaagaaacaagaagaatttatgtccatgcttcgggagcagggttataaaacagccgtcgcttatagcgcggagcaggcccgcgaaatcatccggcattatcttgcccgcggaaaaggtttcgatctggtgaattgtgaagaagcagtaaagatcttcggatattgtgaaggcgtgtccgtgtcatgggcgccgtgtgccgcttgtgaatttttcgaagaaaatcagcagaagaagggagaataaaccatgtttttcaaagcaacagttttgaagcggatgttaaaagcagcttacaagggcgcaggcctgaccgtaggacacagcgccgcaggcgaagacggggggggagccggaaggcctttatatttcttccgggtggtgggtgatctggttcgtatatgacaaaatcccgaaggaagcgaaggcggcgatcattgagatatgcggcgatcttcccgataaaggggaagtattcaaagcgatcaaggatatgggaaaccagtatgaaatcgaacagcgggagatcttcaaccttccggcggccttcaaagggtgcaagactacgttccgaataacgaaattattagggcagcagggggacaaaacgatccgttttctacaagaagaaaacggcgggaaccacgtcaccgcagtttcggaaatctttatggacctgatagatccgggcgcgatcaattacgacggcggcgaatatgaaccattcggaccggtggcagcggacgcaacggcgccgttcatgtactggggaaacaatacttgctatcttatggcaggagtgcgaaccacgggacaaggcgacgaagaagcggcgttctggaagtttttagagggaacggaaatcatttaagacacacagaaagggggcgggcgccgtggcgcataccatagacgacgatacaaagaagattgtcaaagcgattgttcacggcgacaagaagcggcagagccggaaaaggaagggaaagcacacggactttgaccggcgggcagaagaagcgatcaaggccgcaaagcgggaacttccgcttgaaggtatggaccagacagcgcgcgcccacatcatagaccggatttatcagagtttattatataatacgccgtgggaaatgttgggggacacatattgttgccgccgcctattttatgaataccgtatggaattttgttatttgattgccgtacacatggggatcattgagaagcaggcagaggacagcgggggggggcagaagaaaacgggtagcaggcagcaggccggaaagtaggtcagaaaccggcggtgatattggatagaatgaaagaaggttagagcatggcgaaggaatggacaaacggtttctatttgtcgcaggcatggcgccggacacgcgacgcctattattctttacggcgcggccagtgtgaacgctgtatggctgaatgtctggcaggcgcaagaaggctagaagatgtacagccggggatcattgttcatcacaagaaggaactgacgccggagaatataaacgatccacgcgtggcgttatccttcgacaatttagaattgctatgcgaggatcaccacaacaagcagcacaaggcaaagccgaagcgttattccttcgacgcagccggaaacattattgagaataaaagctataaataatttttttcgcacaaaaaaatatttatttcccgcgtacccactccccccggtctggaattttgggccttccaaagagaaccgagggagtgagtacaaaaaaactctgcaagtcgcgcgcacatagaaggggggttaaaatccgtggagaaagaaaaagatagaccggaagttttgaacgataagaacgtaaagaaagagattacaaaattaaaaaaattattcaaagggatagaggacgaagaccggaaaacccttgtaaattcagtgatcgaagaagcagcatttttgaaagtggcgctgacgcaggcgaaagaagaactgaaatcggaaggtctgaccgcggaaacgaaaaacgcttcgcagcggttcataaaagcccacccttcaacggcaatttatgaaaaatatgcgcggcaatatacgcaaattataaatcagttgatcgaatatttaccgccgaaagagaaaaaagaagtatcaaaattagcggcgcttcgggatgaataacgcgataacaaattatatttttcaatactacgacgccataacatcaggtcggatccgggcgggcaagtggatcaaactgatatataaaattctggtagaggggataaacggcggggaatggctctttgattggaaaaaggcaaacaaggcgatcaagtttatagaaaacttctgtcaccattcagaaggacggaacgatcttctaaaactggaattgtggcagaaagcgattgtttccgcgatcttcggcatactggacaagaaaaccgggtaccggcaattcagggaagtatttctgattgtagcaaggaagaacggcaagacgcttttcgcagccgcgatcatggcgtacatggcatatattgacggtgaatatggcgcgaagctgtattgtctggcgccgaagctagagcaagccgatcttgcctacgacgctttttatcagattgtgcaatcagatgatgaactggcagaaataagcaaaaaacgccggtcagatatttatatcaaagactttaacacgacggtgaaaaagatcgccttcaattccaaaaagtcagacggatttaacccacattttgtcttaaatgatgaaatggaagcatggccgggagatcagggcttgaagcagtacgaagttatgacttccgcgattggagcaagaaaacagccgcttatattatctacatccacggccggttatgagaacgacggaatttttgacgaacttatgaaacgttcaacggcgtttttgaagggcagggggacagagcagaccgaaaagcggttgttgccgttcctttacatcattgacgacgtggagaagtgggacacccgcgaagaattggagaagtcaaacccgaacttaggcgtttccgtttcgtgggaatattacgaagaaaagatcgtggttgccagaaagtcacttgcggcaaaagcggagtttctcacaaagttttgtaatatcaaacaaaattcttcgatcgcatggcttgactatatcgacgttgagagggcagcaggccagaaatacacccttgaagacttccggggttgttattgcgtagcggggatcgatctttcccgcacaacagacctaacggcggcgacgctgattattgagcgtgacggaaaaaattatgttatcacacaatttttcatgccgcgggaacgtttcaaagtggcaatcaatgaagaaaacgtaccctacaatatttttgaacagcaaggcttcttgacgttatccggggatcatcaggtggactacaaagacgtttacaaatggttcatagaccttgtgaagaaatacaagatcaagccgctaaaagtaggatatgacagatattgcgccgggtatttggttcaggaaatgaaggaagcgggcttccacatggacgacgtatatcagggaacaaacctgacgccggtattacatacatttgaaggggatctgaaagacggtaactattgtttaggcgaaaacaatttgcttcgatcccaccttctgaatgtggccgttgatataaatatcaatgatagccgtatgaagccggtaaaactagaaagacgggcgcatatagacggcgccgtttcaatcttcgacgcgctggccgtcaagatgaaataccacaaagagatcggccggcaattacagaacaaagcagcctaaaaagagggcttcggccttcttttttgcgttcaaaaagtaggtcagaatttaacgtactttttttgtacgattgaagcatggaaatttgaccggctaccatacgcagaagaaaagggggtgagagcgacgggaattatcaaagattttctgaatttcaggcgtattaaatacagccccgtttttgcaatccgtggcgagtattcagcgggcagcggcatggacgacagcgacatcataggctccattgaaaattgtatttccgtaaacgtggcgaagctgacgccgcagatcgtcagaaaagacagccgcggcatgacgatcaaagacgattatctggcccgccttctttccttgcggtggacgccggaactttccgcgtatgacgcactttataaaatcgcggcgacgctgattagaaagtcaaattccttttcagcgatcctctataccgacgatttttcgcggataaaagcgatcgttccgttgacggttcgggactatcggatctatgaggacgacgcgggaaacattttgtttcgctttacttgggactatgacgggaaggcgtacacgctgccgtatcagaatgtgatccacatcaaggcccggtttaacaaaaaaaggtttatcggaacgccgccggatcagactgtgaagacaacacttgaattactggacgcaacggggcaggcccttaaaaataccgtgaaaaactcggcaaatttgaaaggctatctgaaatacaacaacttcattgatgaagatgaactgaaagagaaggtgaaggagtttcaggcggcctacatgagcgcggagaatgacggcggcatggcggggatcgacaattcaatggagtttcacgaaatcaatcagcggacgccgaacataccaacgcttcaaagccagtatttacgcgataacctttatcggtattacggagtaaatgaagcgatcctgatgtcaaaattcacagaaggcgagtggaacgccttttacgaaagcgtaattgaaccgatcgccctgcagttgtcgcttgaatttaccttcaaagtgctatccgaaagggaaaggggcttcgggaataaaatcatcttcacatcaaaccgacttcaatatgcgacgctgcaaacacgggcgtcaatcggatccgttctgtatgaccgcgggatcattacaatcaatgaataccgcgaattattgtactatgaaccgatcgaagacggcgacgtaagaatggtaagcttgaactatgtaaaagcagacgatcagagcctataccagacagggcagcagagcgaaggcagcggagcgggaccgccgcagggagacgcggaggggcagcaggccgccgcgatccagatcatgaaaatgtttatcccggcaactttgaaaggtggtgagaagcaggaatggagataatcaaaggatttacaatcaaaaaccagacggcgacaagcgcagatctgtatttctacggtgatattgtttccgactggtggggagcatggcagaacgaagaccagtacccggacgcgatcaagaattttctttccgaagcggaaggaaaagacctgaatatttatatcaattcgggagggggatccgtttttgccgggatcgctatttacaacatgatccgcagacacgccgcaaagaacacagtcaaagtgtatgtggacggcttggccggttcgatcgcttctgtcttggccttcgcaggaagtgagccgcccgaaattccttccaacgcctttttgatgatccataatccgtgggcggtatgtgaaggaaattcaacagaccttcggaaaatggccgacgatctggaccagatcagaagcggcattttgaacatatacggcgaacatttaaaagagggcgtgacgcttgaacagatcggcgcccttatggacgcggaaacatggatcaacggggagcaggccgcgcagtatttcaacgttcagaccacagaagcgaaggagtacgcggcagcagttggggactatctggaaaaggcccgctgtaagatcccggacgccttaaaaaaggcaaaaccagcaccggcagcagggcagcaggcagaggaccgggcggcggcagagaagcgaaacgagataaaaaaactcacaatcaacgcatttatgaaaggagaatgaaaacatgaagtatgaagatctggtaaaaatgggcgttgtcgaactgaaagaccgcctgaaagacttaaacaagcaggcgcagaccgcgaagggcgaagccttagacgcgcttctggatgaagcgaaggagatcgacggcattttggacgacatcaaaaagcgcgagaaactggcagacgcggcggcggcagcttccgggaaggagccggacggcggcgaagtgcaggaggaacccaaagacaaggtaagagaggaacgcggccagaatttaaagaacgggaagaccgtcaaattttccgcaaagacggcgatcggcgcaaagaacgcgctttccgttacgcagaccgtcacgccgcagcacagcgccgcagatgtaagagaaaccttcaatgatgtttcttcccttgtggaccgcgtgaaggtggttccgcttgcaggtggcgaaacataccagagagggtatgtaaaatcttatggggacggcgcgggagcgacggaagaaggcgcagactacaacccgacggaaccggttttcgggtatgtgacgatcgagaaagagaagatcaccgcctacacagaggaacccgaagaaatggtgaaacttccaaatgctgactatgacggagttgtggaaggatcggtttctaaagcgatccgccgctacatgggccgccagatcctgatcggtgacggagcaacggggaaatttaaaggtattttccacaatcccaccaaagccgaagatcaggtgatcgatccggcaacggatattgaattgacagcgatcgacaacaagacactggatgaaatcatttattcctacggcggcgaagaagacgtggaagacatggccgttttgatcctgaacaaaaaggacctgaaagccttcgcgacgcttcgggacaagcaggatcgcaaggtttacaccattgtgaaccacggaaacaccggcacgatcgacggcgtaccgttcgttatcaacagcgcgtgcaaggcaatttctgacacggcaacggcggcgggggcctacattatggcatacggtccgttggaaaattacgaaatggcgattttttccgacattgacgccagaaaatccacagactacaagtttaagcagggacagatcgcataccgtgcggacattttcgcgggtggagccgtagcagcatacaacggcttcattcgggcgaagaaggcttccgcgtaagtagcagcagaaaggacggcttcacatgacgattgatgaattgaaggccgccgcaaaaatccgggcgcggaaaatgtcaacggacgcattggacgaagacgttttccgctatatggattttgcgatcgcggatttaaggcgaataggggtagcggaagaatacctgacaagccccaaagatcctttgattgttgaagccgtcttaacctacgtcaaggcaaattacagcatggacagcaatcacgaacggttgatgaacaactataacatgatcttgacgaagataaaaggcggtgactacaaatcgaagcagtagtaaagctgattgatccgggggaaacacgggaagaagacgtggaaacgccggtttttgcaaaagtgaacccgatcggccgggatgaatacgcgacagcgggagaaaaaggcatgaaagcccgctatatgtttgaagtgtacgcgaacgaatacagcgatcaaagcgtggtgatcttcggagaagaacgcctgaccgtttaccggacttatggaccgaaggacgacgacaagatcgaagtatacgccgcacagagagtggggaaccgataatgggattgagtgttgataaactggcggcagaactggcgcaggggcttagtgaatattcacagagcatagccgacgaaataaagaaggcagccgatgaagcggcaagcgcggccgttagggaattaaaaaacacaagcccggctcaaacaggatcttatgcgaaagggtggacaaaaaagaacgcctatgaagaccgaagatccaaacgaaacacagtttataacaaaaccgattatcagttgacgcaccttctggaaaaaggacacgcaagcaggaacggcggcagagtggcggcgcgggtacatattcagccggtagaagaaaaagtggtggcagattttgaagaaagggtaaagggggcgatcgaagggtgacgacgtttgaacagattttggagcgggcggcaggcttggggcttccttttgcacacatgcaatttattccgacgaataaaaatccggtaccagatccgccgtttcttgtctggttggcagatgaacagcagcgcggcgacgatagcagaaaccggatccggcagattgacggatcgttagaactgtatacagaaaaacgggcggatccggcccttgaaaagcggatcgaagacgaagtgttgttcgacgtggagtttcgcaaatttcaggcgcagatcccaaacgaagacacgatacaaacggcgtatgactttacaatcacacagaaaaaatgaaaggagatcagagcatggaaagaattatccttggaagtgctgacgtttatattcaggcgttcgacggaaagacggttcccgcgacgtcggatatttgcgttaaagacaacttaatggcctacatttccggcggcgcgtccgtagaatacaagccgtctttctacacggcaaaggatgataccggaaacaagagaaagacaatcattaccgaagaagaagtaaccctgaaaacggggatcatgaccttcgacggaaaaaaattcgattatctttgcgacaccgcccgcgtgacggaagacaaggcgaagaagcgccggatagtgaagatcggcggcctgaataaccggaagggaagccgctatgttatttgtcttcaccacaaagatccggtggacggcgatatttggacaatgatcgtaggaaataatcaggcgggcttctctatttcctttgagaaggacaaagaaaccgtaattgatgaagaaattacagcgcttcctatggacgacgaaggaacacttttactgtatgaagaagaaatgacagacgaagaagcggcggcaagcaacggcaccgcataacatcaggaattacaacggcagggcggcgctttgccgttgtttcgcagaaaggagaatttaaactatggcaaatatggcgtttgattttaacaaggtgaaacggtcctttatgacggcgacgttaaaggacggtcggaaattggttgttaaaatgcctatgaagaaaacctttgaaaaaatgtcggcgctgcaggaagtggatgtggacaacatgagcgttgacgacgctatggacacgttgggcggcctttgcgcggaaattctttcacataacatgagtggggagcgagtaacggcgcaggaaatcacggacaactacgacacagaagaaatggaagcattgatcgacgcctatatggaatttgcgggcggcgtacagaagaacccaaactaaaggtccccttctatccggggcaggatagtgaaggggtttattataaaacccaaacccgcggggaaaaactggtgattgattacaccggcttgaacttgtgggaagtgcaggaactggaccttgatctataccttttcttcatgcgcgaagcgtttatacacgaaatgaaccagacggagcaggggagagaataccttgaaaattgttggcgcatttcacaaacagaaccggaccgaaaggccattcgcgagaagtttaaacgaaggggcggtgaatagcgggtggcagcaagcacaatcaaagggatcacgattgagatcggcggcgatacgacgaaattagacaaggcgctgaccggtgtaaacaaagaggcccgcgacatccagaaagaattaaaggaagtcgaaaaggccctgaaattggatccgaaaaatacggaattactggcgcagaagcagacacttctgaaagaagcggtggaagctacgtcgcaaaaactggacgttttaaaagaagcagaagcacaggtacaaaagcagtttaagaacggcgaaatttcagaagaacaataccgagcattgcagcgggaaattgtcaaaaccgaagcagaactgaaaaacttaaaagaagcggcagagaagggaaactccacacttgaaaaggtaggggagatcaacggcaagatcggggaaaagtcaacggcgcttggaaagaaacttcttccggtgacgggggctattaccgggttaggcgccgccagtattgcagcatttaatgaacttgataccggatatgatacgatcatcaccaaaaccggcgcttccggggaagcactggaaggcttacaagaaagcatggacaacgtgttttcttcccttccgatcgaagcggaagaagcagggatcgcgatcggtgaagtcaatacacgtttcggagagacgggaaaaacattagaagatctgtcaacaaagtttattcagtttgcgaatatcaacgggacagatttaaacggagcgatcgacagcgtggacgccattatgacgaaattcggcgttgacgcttcacagacgggaaatgttcttggccttctgacgaaggcgggacaggacacgggaatttctatggacacgcttcaaaattccctccagacgaacggcgccacactaaaggaaatgggccttgatctgacttcttccgtgaatttacttgcacagtttgaagcaaacggcgttgacgcaacaacagcgcttgccggattgaaaaaagcacagcagaacgcgacggcagaggggaaaacccttgaagaagcattgggcgaaaccatagagagcataaagaacgcagggagcgaaacagaagccctgcagatagcaacggaacttttcggaaaaaaaggcgccgcggaaatgacgcaggcgatccgagaaggccgtttgtctgtggatgatctggccggttcgttggaagattacggaaatgttgtcgaagacacattcaacgcaacactggatccgccggatcaagcaaaagtagcgctgaacaatttaaaagtagcaggcgcagaacttggaaacacgttaatgtcttcacttgcgccggttttggaacgtgtcgtggagaaggtaaagacattcacaacatggtttaaaaacctgaatgacaagcagcaggaaacgatcataaaggttgcggcggtagttgcggcaatcggaccggccttgattatattcggaaaagtggctacgggaatttcaaaaattatttccgtggcgacaaagatcggaccggttataaaagcagcaaaggcagcgtttaccgcgtttcatgcggtactggcagcaaacccgatcattttgattgtgacagccattacggggctgattgcgatccttgtcactctatataataaatgtgattggttccgggaagctgtggacaaaattttttcagcgataaagacggcatttttcgcagcctttgacgcaatcaaagaatttttcacggtgacgcttccgggagcgattggcgcggccgtggagtttttcgcggggttgtgggatagcatagttgaaatttttatcggcgtcggtcagtggttttccgatcggttcaatgaagcatatacagccgtgaccggtattttttccgggatcggtcaatggttttccgatcgttggacggacataaaaacggcgctttcaacggtggcgacgtggttcttgacaatgttccagaacgcctacacgaacgtgaagaatgtttttgcggcgattggccagtggttcggcgcccgttggacggacataaaaacggcgctttcaacagtggcgacgtggttcttgacaatgttccagaacgcctacacgaacgtgaagaacgtcttttcggcgatcggccagtggttcggcgcccgttggacggacataaaaacggcacttgcgacggtggcgacgtggttcttgacaatgttccagaacgcctacacgaacgtgaagaacgtcttttcggcgatcggccagtggttcggcgcccgttggacggacataaaaacggcacttgcgacggtggcgacgtggttcttgacaatgttccagaacgcctacacaaacgtgaagaatgtttttgcggcgatcggtcagtggttttcggcacgttggacggatataaaaaacgtattttcggcagtgggaacatggttccaaacgaaattcaatgaagcgtacacaaacataaagaacgtgttttcaaatataggtacatttttttctggaatatggtcgagtataaagggcgtatttacgaatgtaggaactaatataggaaacgcgatcggcggcgccttcaaaactgcgataaacagcgcgatcgcaacagtagagaacgcaataaacggcgcgatcggacttataaacggcgcgattgacgttatcaataaacttccgggcgtaagcgtgggccatgtgggaaccgtatcacttccacgtctggcaaaaggcggtattttgaagaacggtcaagcgatcatggcagaagcggggccggagttgatccaaatggtgaacggtgaagcgattgtgacgccattaaccagaagcgcgaaaaataccgcgcttgacgcggccacggggcagcaggcgcgaagttttgtccagaacgtgaacattacaagcccgaaggaactttccccgtatgagacggccagacagaccagaaacgcgacgcggcaaatagtattacagatacaagggggcgtttaagcatgaaaagaattatatgcagaaacgaagacggggtacaagtagaatttaactataactttgaacccttcttccttgtgtcggtggacgggatctataccgtttcaaataatgttgtcacgtcggaaaatacaatggttgacggttccacctatcagggaagcaccacgaagcagcggaacattgtaattacggcgcaaatggaaagtgattatcaaaaaaatagggacttgctttataagtgtttcaagccgaagtcgacaggactttttacctatatggaaaatgaagaagtacgggtgattgactataaggtggaagacatagacattgacgaaaaagggatcgtaaggaattttacaatttcccttctttgcccggatccattcttccgggacttggaagatctatccgtatcaatggcaagttggacggggctttttgagtggccgcatgagtttttagaggaaaaggagccgtttgcagagcgtactgcggaagtgttaaaggagattgagaacgacagcgccgcggacaatatcggtattaccgtaacactggaagcggaaggaccggtgataaatccggccgtatatcacgcggaaagcggggagtttatcaaaatcgggaccgaagaacggccgttttctgtaaatgccggtgacgtggtaattattacaacggaaaccaacaacaaagccgtgtatctggtgcgcgacggcgtaaaaacagaagtcaatgaatatctggacgaagacagcgattttatacagttgcagcatggaacgaacacgatccgttacgcagcagacgccggggaagactacatgaacgttacaatttcctatcggttccgttatttgggggtgtgatatggaagcgcggatttatgacagaaatttaaattttaaaggcattatagaaaatcatacgtccttaatatgggatagaaagtattatgagccggggaactttgaaattcacgcgccgatcacggatcgcaatctggcattactggcaaaggggaacatcatttcaaagcggggtagcgaagaagctggagtgattgaggatatagagaacgaagaaagcgacattaaaaacgagattaccgcgaagggtcgttttctttcttcctacatggatcggcgcctgataaaatcaacggtcaatttttccgggaaagtagaagttgccatgcggcagcttttgaccggggccacggcgatcccgcttgtggaacttggaaccctaaacggtttcaccgaaacggtggagtttcaggctaccatgaaaaatctaatgtcctacgaaacaaaattagcgaagtcggccgcgatcggttatcggttccggccggacttccggcaaaagaagattttgtttgaaacatacaaaggaacagaccggacgacggcgcaggggatcaattcccgtgttatcttttcggaaagttataacaacctaaacaatgtgatttaccgttacaacgatcagcagtaccgcacaaaagccattgtgggcggggaaggtgaaggagccgctcgcgtatatgtagaggttggcggcggtaccggcttagatcttcgggaaatatttgtggacgcaaaggacattcaaagcgaaggcatgacaacggcagcatacaaagcagccttgtcacagagggggaaagaagcccttgcaagtaatatcatagccgaaagcgtggagtgcgaaacggaagcagatataaactttaagtacaaaacacactatgatcttggggatattgtgacggtaaaaaagaagaaatgggggataactttaaatcagagaataacagaactacaagaagtttatgaatacgggggaatgtatgtagtaccgacaatgggcgacgcattaccggaaaaaatagattggagtgataaataaatgggacagtatgcaaacttctataattccagaaatggggaccgcgtttataatgcggacagcatgagcgaatggcttttaccattcttcacaacgggcgttttcaataattgttttgcgatcacagcaaacgacgatatgaccgtaaccgtcgcagggggatatgtaaatatcaacgggaagacaaagcattttgaacaggcgcagatcttcacgcttgaaaaggcgtcaggaacactggcccggatcgacaacgtgatcttgcgtcgggatgataccgaaagggatttttatattttcattgaaaccggcggcttttccaaaaatcccacggcgccggagattgtgagaagcgaagcggtccacgatctgaaattggccgaaatatatgtggatgtgggcgcgattaagatcacgcaggagaacatcaccgacacgcgcatgaacagcgacgtttgcggttgggttatggcgacggtaaaggaaattgacttttcgcaggtcacggcgcagtttcaggcgtacttcacacgctatcaggccagtataacgcaggaatttaattcctacatggcgcagatcgtcaatttagaggataaaggcgccgccgcccttcgggatatggaaagccagtttgaaagctattcacagcagcagcaggcggtctttaccgcgtggtttgaagggataaaggatcagttatccgaagacgccgccggagccttgcagaacgccgtgaacgatttgacggcccacataaaaaatcttgcaacgaaagtaatgtttgaaaatctgtcaaaggaaaccggcgtgatcctgatcgacattataaacaaggacagcgggaacaaaacgacggttacatattcggcagagggaaaaacctatctgacggagccgggagaatacacggtggaagcacaaagcgacaccttgaacattatcccgaaaaccttcgttctggaccatacgaagacaacggaaacggttacattcagtatttacgacaagaacgctttcgcagccgtgggcggctatgtgggcgcctatgtatcatcacaaaattaaagaaaaggagaagacagcatgaaaggatttccgaaagtattaaaaacagcgcaggacgtgaagaattgtcgcacattggtagcggccggggaactggaagccgcggatcttctggaagcgatcagcgggatcgaaaatcagaatttcatcacttgcccggttatggatctgtcagaggacagaaagacggtaacggttatgtattgcagcgaagcggcagcagaagggaaagtgacggcgggcggcgtgacggccactattcagaccgtggagcatttgaacggggagccggacgaagaaggcaaggtggagaaagagaagatcgcgatcacgttatccagagcgatcgctgccggttccgcgtcgctgaaaatccacaatacgccgtcggtttatgaagccttagacattaccgaagacgaaatgaaccagatcaaagaagaactggcagcaggccgcgtagtgtaagacaaaatcaggatttacaaagcagaagggagaacagaccatgaaattttttctttatgacgaaaccatgatgaacacgaaggcaaagatcaccacggcgaagttgtcagctatgggcgacattgtggcgcagaaggcgcagtatatcaccgccgccggttccgcgtcgcccgatcaggtaacgatcgccgcaggcgtgataatcgccgtcgggccgtcaatttttgaaaccaccttaaccaacttgaccgccgcgaaccttgacactggaagcggatttgagaagggcagcgattattatatttattgttgtgatccttccaacggttccgaaacattggatcaggatgaaatttttgtgatttctaaaaattccacctatccttccgggtacacagcagagaacagccgcaaagtgggcggcttccattacgggatcgtaaggcgcgtaaacgcaagcggaaacccgatcagcagcagcgggacggaaaacggcagcggttgggaaggaaatgtgtatacgggaattgtgccgaacagcgtatggacaacaaagcaccgtccgaagtgcgacgatccttccggtatggtttacttggggaatggattgtggggcgatatttatttatcatccgacaatggaagcaacggcctgcagagcaaatataacgcgacgccgatcaccggaacggagggccttaactggtatatcgcaaacgagaaggcccgacgcgtcggaaaacgccttcccacctacgcggaattttgtcaggcggcagcaggtagcccggaggggcaggacgggaacaatacctacgcatggagcgcgacgggaaacaccggacggcagaaaacgggatatgttcagaacgctatttccgcgttgaatatccgcgatcttgtgggtaacgtctggaaatggcttgacgaattttgtttggatcccacagcgacaacgtgggcgtggcaggatgtacttggaaccgggtatggtgacgcttatatgccttcggcgacagcccttctcgcgctgcttggcggcgggacttggtacaacggcgttcgcgccggttcccgcgcggtggcttgcaacaattgcccgtggaacgtccacacgtacgttggcgtctggtgcgtctgtgacgcgctgtaagcagaaggggcgcccgaaagggcagcccctaaaccttccgggagaatgacacatgggaaattatcaaagcagaagcaaaagtgccacgggcagcgcgcaggcgacggcagaaatggattatacgcatacggacgcgcaccaaatagcctatgatttttcaatttatcttcacgaaaaattgaagaaatttccgcattatgagaaattcacgcttcaaaaggacatacgggagagcatagacgcgcttttggatgaagtcgaaatgtacgagatcacgaaggttgcaagccacctttacaccgcggaccggatgaaacggcggcttgtgcggaaacttcgccttgcacatgatttaggttattcggctataagcgacgggccttatttatactgtgcgaagcagaccggcataataggcgctatgatcggcggcctgataaaagaagtacagcaggcgaagaagaaataaagaattttggggcaactgttaattcgcaccttcacgcgctgattggcggcgggaattggaacaacggcgttcacgacggttcccgcgcggtgaattgcaacaattacccgtggaacgtcaacacgaacattggcgtctggtgcgtctgtgacttataaagcattttagaccgcgtgatccccggatccacggcaagggttatatatggataatctcaatatatagtcagacggttgcaaagacggcgaaagccgttcccgttccggcggcataccggacaaacgtaaaatagcaccgcctgaaagtaacccggaaggggcgaaatgaggtagggcaagtttagaacatgaagacagctaaaaatttgatagaaaagatctgcactttcacaaacgccttgaaagcatatcacaaggccagaaagtgcaagcggtaccggccggaagtcttagagtttgaagcagaccgcgaaacgaatttacttcgtgcagtgaaggctttaaaagacgggacctatcagccgggaaaataccgcgttttcaaagtgtgggagccaaaggaacggatcataatggcgcttccgttcttcgatcgggtgatacagcacatgatcgtaaacctgattgaactgatttttgaaaagcgttttattttccattcctacgcctgcaggcagaagaagggcgcccacgaagcaagcgaaacactttcccggtggctttataatctggaaatagtgaaggggaagaagatatacgccataaagggcgatatacaccattatttccagagcgtttcacatgacatattgaagcaggagatccggcgctacatatccgacaaagcattattgaaaatccttgatcggatcatagaccataacgggatctttccggtgggcgtgggaataccggttgggaatctgacttcacagcttttcgcaaatgtttatttaaataaattggatcagtttgtgaaacatgaattgaagttgaaatattacgtccgttatatggacgattttattattttatcggaggatcccgcgcaccttcgccgcatactggcagaaatagaagatttcttgcgccgggaattacgcttggaactgaacccgaaaacaacgatattagccgcaaagaacggaataaacttcgtaggctatattcactacgcagatcacaaaaagatccgcaaagcggccatgcggcgcttaaagaaactattgcgggcgtttgaaaccggggaagtagaattggaatacttcgatcgttccatagaaagccggttcggacacatgggacacgccgacacgttccggttaatcagggacacgcgggaaaccataaaggaattgaaggaaagaaaggcaacctgaaaaagaaggtcagaaattgccggactttccttttattatggttttgaaaggcggtgaggaaaaatgtcagaatggcaggttataacaatgcttatcacgttgcttggcggcgcggcggtcattgtgcggcctatcttaaacttgacaaaggcgatcacggaattaacttcaacgtgcaaacagttagatcagcagttttcagattttgaaggccataaccgggaaagccataaaagattatgggaccacaacgacgaacaggacaagatcctgcagaaacacgaaaacagaatttctattttagaaagagggaaacacagtgaagaaagttaagaaagaaacgatcatcaggacggccgttttacttctagcgattgtaaacaatgcgcttgcaatcgcaggaaaaagcccgcttccgtttgacgatcagaccgtaacggaagtaatttctttcgcctttaccacggccgcgtcacttgtgacgtggtggaagaataacagctttacgcaggcagcgatcgaagctgacgaagcactggacaagatgaaagcacagcggggagtgtgagaaaatgacggaaaaagaatttgtttcctacatcggcccacttgcggcggccgatatgaaaaaaacggggatccttgcgtcagtgacagtggcgcaggccattcttgaaagcggatatggatcaacggatcttgcggtagtagcaaataaccttttcggcatgaaggcgacactttccgggaataactggccgtctgaatgggacggccagacctacacaaaggaaacgaaggagcaggacgcaagcggcagagaatacaccgtgacggccgcttttcgcaaatacgccagtcatgccgcaagtatcaaagatcattcggattatctggcaggtgcgaagaacggttccgcgtttcggtacgccggattgatcggagaaacggactacaagaccgcgatcgcgattatcaaaaacggcggctatgccacagacacgaagtatatagaaaaaatctgtaatattattcagcggtgggacctgacacagtacgacaccgcagaaaggagcgaagcagaaatgaatatcattgaaagcattgtaacaaattcggattgctacaagacaggacggacaatcaccgtaaaagggcttatgcttcattcggtaggttgtccgcagccgaaagcgtcagtgttcgttgataactggaataaacccggcgcgtccgcttgcgttcatgcagtcattgacgcggaagggcgggtgtatcagcttttaccgtggaaccgccgcgggtggcattgcggaagcgggacaaagggatccggcaataatacgcatatcggcgtagaaatgacggaaccggcaacaatcaaatataccggcggggcaagctggcaggaaaccggagacgggaacaacacgcgggcgcacgttctggcaacatataaaacggctgtagagttattcgcgtatctgtgcaaaaagtacggattgaacccgacagcagacggcgttattatttcccacagcgaaggccattcccgcgggatcgcgtcgaaccacggagacgttgaacacatctggcgaaaattcggtctgacaatggatcagttcagaaaggacgtgaaagcggctatgaacggatccggcggcacatccgcaccggccgcaggtgcggaactttaccgggtgcggaaaagttggagcgacgcgaaaagtcagatcggcgcgtatcatgttttagagaacgcaaagaaggcttgcaaagaggggtacacggtttataacagcaagggcgaagccgtatatacgaatacggcagcggggcagcaggcgcccgccggtgtgccgtataaagtgaaagtggatatttccgatcttcggatccgcaaaggaccgggaaccaactatggttccgcaggatataccggcgaaggggtattcacaatcacggaagaagcagacgggcagggggcgacgaagtggggccgcttaaagagtggcgccgggtggatttcccttgactacgcgacgaagatcgcataaaacaaaagacacacctccagacggaaaaggaaaatatatcacgatcccgcgtcaataaaaggcgcgggaaatttttatattttcgagcgttgattttctggcgggcgcgtggtatgttcagaatagatatttttgaaaaaagtttaaatattgcgcaatatcctattgacatattgcgcaatatgagttataatataatcagttaaggggaagacctttaacgaataccgggcaagcggagaaaggagagcatatggaagacgtgaaagaatttgttgcatattgtagaaaacttttaagaacacttaacaagttggaaaaagcactggacgataacgagattgaaaaagcgaaagaacttgttcaggaattaaaagaagatacgcagaaagacattgaagcgtaactgataagggaaccagaaagggcggcggacttgccaaaaccgcccgatctgttaaaaagattatacatcatattcggggcggtttgcaatatgcaggcggcttttcttttttgaaaaatttttaaaatattgcgcaatattctattgacatattgcgcaatatgtgttatattataattacagaaagggaaaacaactattcaaagaaaaggagatctaaccatgagaacatacgaagaattagtaaaagaagcaatcacaaaagcacatcaggaagcgcaggcaatagaggaagcgaaaaaccttcgttttgaggtcggaaagacctaccagacaagaagcatttgtaaccatgattgtatttttaaaatcaccattacaaagcggacagagaaatttgtcaccgtagacaaaaggggcgaaactacacgttgtaaaatccacatgattgacgggaaggaagttattttcccatacggtcaatattctatgtgtccggtgtttcacgcggacgatatagcagcataaccacacgacaccgggacgggcggggaaccgtcccggccgttcgcttctttacaatattacgcaatatgtgttattatgacagaaagagaaaaggagaactggaaaatgaaagaatttaatcaatttcagtatcaaaatgactataacaaaaagaaatatgaccgacttaatttgaatatgcagaaagggaaaaaagagaagatagaagccgccgccgccgtgttggggatgaagatcggggaatatatcaacgccgcgattgacgaaaaaatggagcgtcaggccggggagcaggcggcgggagaagcgcaggaatagcgcaaaacgttccgaaaatgagccatgcaataacaaaaaccggccttttcgtttcgaaaaaaccggttttgatacgctttccgctgaaatgttacgcttcaagtaccagatcatagaatacattttcggaaagtatttctatatcatggccctttagaattagggcttcggccttcttctgcttgttgcttttgccgtcctttatggattggcaaaaatcattattacctaaaattaaatagttggttttctttgtgacgttatcgccgacggagccgcccaaatcaacgactaattgcatggcgtctttgcgggccattttttcaagggttccggtgaatacgcacactttaccgaaaagcgggtgggaagtattaaacgaagtcttttccgttgaaatatccttcgcatgaagagcgcttcttccggtggctgccttgaaatcatccagactttgaccggccgccagaatatccgcctgcagcttctcaaaaatggcgtggcatatttcacaatcagcggccgccctatgagcgccggaagcagaaacgccgtaatgatccgcaacggtggcttgcttatggtttttcagatccggaaggaccttccgggcgatccgcataacgtcaacaaaggaatttgacaaagtaagcgaatgacaccttttaaggttatcaaacaaaaagttaatatcaaaattgacattatagccgactaaaagatcatcaccgacaaactcataaaatttttgtatgccttcggatatatccggggcatttttcaacatatcgtttgttatgccagtaagtgcggttatgtattcgtcgatcggttcatccggttttacaagcgtcgagaaggcgcccaccttctgaccggaagaatatttgacggccgcgatctcaataatatcacaataccgcggatcaaggccggttgtctcaatgtcgatcactgtataggaagtcggaaagtctataacgctttttcctttgccttcccgcgtgattttttcgccggatccgtcggaagtggtgacatacgggcgcccgttttcgtcaataccaatagaaataaacatattttgttcccccttgcggttagattttttgagggcagcaggcgaaaagtttttcgttgctgacctttaacacaattctaggggcttcatgtgttaaagtcaagaaagtttctgaacattaacacatgaaggagccgcggacaatgaaaatatattcatataggggaaagaaaaatctttgcggcgacaagatccgggaagccagactgaaacagagactttcacaatctgatttagcggcaaagatacaaattgaaggtgtgacactggaaagggacagcataagcaggattgagatcggaacccgctttgtgacagattacgaactaaaaatttttgctagagttttgcgcgtgaatgttggaatggttattggaagaaaacgaaggataacgccggggctataatggctcacggcgttatttttttgaaaggagccaaaccatgagacattttcaccacctgacacatgacgacagaataaagattgaagcacttttgaaggagaaacacacgccggaagaaatagcgaataatatcggctgtcacatttctaccatataccgggaattaaagcgcggccgatatgaacaccgtaattcagattggacgacagaagaacggtatagcccggatatagcagatgaaaaatatcgggagaatttggccgcgaaggggccggggctgaaaatcggaaatgaccttgcactggcagaatatattgaagacaagatcatcaatgaaaaatattcgccgggggccgtgttgggcgagattaaaagaaaagggatcgctttttctgtcacgataagcaaacccacgctttataactacattgacaaagggatctttcttcatctgacaaataaagatttgccggtcaaaaaggacgaaaagaagaaatataataaagtgcgtcgtgcgcgggcgcagaagggcgacagcatagagaagcggccggaagaaataaacacgcgggaaacctttggacattgggaaatggacaccgttctaggccttcgcgggaaaacaaagaaatcatttcttgtactgacagaacggaagacaaggaaagaaatcatcatggagttaaagaaacatacggccgccgaagtggtgaaggccctgaacagacttgaaaggaagtgggggaaactgttttataaagtgttccagacgatcaccgttgacaatggatcggagtttgcagactttgaaggattggagaaggcagcgcgtaggaagggaagccgattaaaactatattattgccatccgtacagcagttatgaaagaggatccaacgagaaccaaaacagaatgatccggcggcaggtcccgaagggaacggatttcgacacactaccagaaggaacggtggaaagtatagagatctggatcaacaattacccgcgccccatgtttgactacggcacagcggaagaacgcttcaacgaagaactggcagcactggcataaatgacagattgtgaaatatgcacaaaaaattgaatagaaattgtgaaaaagggagaagccggaaacctcgaaaattttttgcatttaacgcttgactttttagtgtacgttccctggcacattttttagttccctaatatccggaaaggtgatataatacaaatatctataggttttaagagggctgaaagatgaaaaaggatataaagttaaagggacaactgaaattgtatatgcaatggccgggaattatgattcttttccttatcctgatgaatatctggatcttcaggatggatcgaaaggccgggctgcttatgagtgcgtttgtgctggtttatgcagtcgtcattggcattatgtatttttacaataagtctctgattctggcagacatggtagagtttgcagcgcagtacgggattgtccagaatacacttctgaaggaactttcgattccgtatgcgattttactggatgatggaaaaatcatctggacgaacacacagtttcgggaagtccttgggacgactatccggaaggatacctatctgagtaaatatattccggagttgaaccggggcgtatttccaaaggaagagaatgaatcggtaagcctggaattcaattatcttgacagagattatcaggctgagatccagtgcgtatcggtcgaaggtttcagtgagacagagcagcttctggagataccggaggaaaaggaatattttattgcgatacatcttcaggatgtgacagagctgaaccggtatatccgggcgaatgaagagcagcggctggtggccggactggtttatattgataactatgaagaggtcatggaaagtgtcgaggaagtaaggcagtctcttctggtggcattgatcgaccgtaagatcaaccagtatattgcggatttttccggtattgtgaagaagcttgagaaagacaaatattttgttgtaattaaaaaagaaagcttcaatcgaatggaaaaagaccgtttttctttacttgatgaagtaaaaggagtcagtatcggcaatcagattccggttacactaagtattgggcttggactcagtacagatacctatgctgcaggatataattatgcccgtatagcgatcgatcttgcacttgcaagaggcggagatcaggtagttgtgaagaataacaagggaatcagctattatggcggaaagcgtgagcagactgctaagaatacccgagtaaaagcaagagtaaaagcagaagcactccgggagtttatcaccggaaaagagcgtgtgatcgtaatgggacataagatggcagatgtggattcatttggtgcggcaatcggtatttaccgggcagcaagtgcgatgaaaaagaaagtcaatattgtcctgaacgatatttctgtgacactcagaccgctttatgaagcatttactgatgatccgaagtatccggatgatctgtttgtgacttcccatgaggcggaggaactggcagatgacaatacaatggtagttgttgttgacaccaataagccaaagatgacagaatgtgaacgcctgcttcgtctgacgaagacgattgcagttctggatcaccacagacagagtgatgaagtgattgagaatgcggttctgtcgtatattgagccatatgcttcctcggcgtgtgagatggtagcagaggttcttcagtatatcggcgatgatctgcgtttgaattccatggaagcgaacagtatgtatgcaggtattctggttgataccaacaatttcatgtccagaacaggagtccggacctttgaggcggctgcgtacctgagaagatgtggcgcagatgttacttatgtaagaaaactcctccgtgatgatatggcatcttaccgggcaaaagctgcagtaatcagcagtgctgaggtatatcgggatgtatttgcgatcgcgcgaggcgaacatctgggaattgaaagtcccactattatcggagcacaggcgtcaaatgagcttctcaatattgaggagattaaggcttcttttgtactgactgaatataatggtaagatttacatcagtgcacgttccattgatgagatcaatgtacagatcattatggagcggctcggcggaggcggtcatatcaacactgccggtgcccagtttccatattccgatatggaaagagcgattgaaactctgaaaaagacaatcgatattatgatagaagaaggagatatttaagatgaaagttattttattggaagatgtaaaatcccttgggaaaaaaggtgaggttgtaaatgtaagtgacggatatgcaagaaacttcattttcaaaaaaaaccttggactggaagcaaatggaaagaatttaaatgacttaaagcttcagaaacagaatgaagaaaaggttgcacaggagcatctggaagcagcgcaggaacttgcaaagaaattagaggcagcaaaagtagaactcaagatcaagaccggggaaggtggaagaacattcggttctgtgtcttcaaaggaaattgcaattgcagtaaaagaacagctgggatatgatcttgataagaaaaagatccagatcaaagaagcaatccgtacacctggaatgcatcttgtaccggtcaaacttcaccagaaagtgactgctgaattaaaagtgcacgttggggaagcttaggaggatctgagacatggatgaagcactcattaagagagtaccgccacacagcatagaggcagagcagtctgttgttggagcgatactgatggaccgggatgcgattacagtagctgccgagatcatttgtggagatgacttttatcaaaaggcatatggtgtaattttcgattcagtggtagaactttttaatgagggaaaacccgttgacctgattacactgcagaaccgtctgcgtgaaaaagctgttccggaagagatcagtagtcttgaatttgtccgggatctggtaacagcagttccaacctcggcaaatgtaaagtattatgctgagatcgtctctgaaaaagcaacgttgaggcgtctgatcaagatgaatgaagcgattgcggatgaatgttatcaggggcaggagccgctggaggcgatccttgaaaggacagagaagcaggtttttgagctggtgcagaaccgcggaggaaacggtgaatacgtgccgatcaagcaggtagtgttaaatgcccttgagaaaattgagaaagcatctaagagtaagggaactgttacaggaattccgactggatttattgacctggattacaagacatccggtctgcagccctccgatctgatcctggtcgcagcccgtccttctatgggtaagacggcgtttgtactgaacattgcacagcatgtggcgtttaaacagaatcgtacagttgccatattcagtctggaaatgtcaaaggaacagctggtaaaccgtctgttctcgctggaatcctatgtagatgcacagcttttaagaaccggtaatttgaaggattctgactgggaaaagctgatcgaaggtgccggaacaattggaagatcgaacctgatcattgatgatacaccgggtatttcgatttcggaaatgcgttccaaatgcagaaaatataaaatggaacataatcttgagctgatcatcatcgactacctgcagttgatgagcggaagtgttggtggacgtaatgagtcccgtcaacaggaaatttccgatatttcccgttccttaaaagcgcttgcccgagaattaagtgtgccggtcattgcgctgtcacagctgagccgtgcggttgagcagagaccagatcacagaccgatgctttctgatctgcgtgagtccggagcaatcgagcaggatgccgacgtggttatgttcatttatcgagatgattattataataaggatacggagcatgtcaatgaggcagagatcattattgccaaacagagaaacggtccgattggaaccgtaacgcttacatggcttccgcagtacacgaaatttgccaattcagaacgaaaagttgtggatggggaatgagaaattatgaaatgaaaaagacagggaacagaatcaaaactgttcgctgtcttttgacttttatgtggtttcgccaaataatttccgcaggtaatgtccggcggcagattttgaagcttctttccggagcgcctgctgctgacgaagtaaatgatcaagcttccggtaacggtcttcttccaggcgttcttttgcctgtaaaagaaaatccatttcctttgttactttttcagatacggatttgccgagagacccctccaggatctggttgttttccaaaagaatttttcggagagactcttcgagcagaggctgataaacagaaagagaaaggttgtcttctgtataaacagaaagagccggatcctgggggtcagcaacttcgtttatcgaagcggcagcctttggtgcatccgattttctggccttcagaagtgcttttgtgcgaagcatgtccggaaggagctgtttgatctccttcaggagtagtccctgttctttgagttctttgatacagctaaaaagctgtatatcttcttccgtatagtgccgatgtcccatctcagtgcgtccgatcggaagatcaagctcttcctcccagtagcgaagaacatgtgattctacgccaacgtgtttggcagcttctgagatcatgtaatgaacgtcgcccatacgataacccccttattaaaataagtatgtgatatagattgagtacaagtctattgtagcataagaagaagagatggaaagaaaaatcgttcgacaaatgttgcagagggaagaatgtcagataggatgatgcttactggatctgtatttggttcagacgtatacataaaaagagacgatcttcagatgaaaatcgtctctttcttactgtcttattcaatctacgtgttctgattactcagcgctgattgctcctgtaggacatgctgattcacaagcgccacagtcaacacatgcagaagcatcgatctgcatatgatctgcacccatagagattgctcctactggacattcgctttcgcaagctccgcagcttacacattcgtctgaaattacgtgtgccatgatatgtatcctccttattattatgaaaaagttaaaatcgatatgcctttcgcataactttattctaatacagaacttgaaaatatacaagaggaatttatgcttaaaaatagatacaattgagttagaaatgtcaaactaatagcgcgaaatgggcatttctttggttagaaatataaaaccaaaaggttagtaatataaaacttacaaatgaaaccaaaaagaatttatgaaatcttaagaaatttttctacctttcccgggcgatttggtgtatagtgggtactgtatcattttataaccaataatgaaactgattttaagatagagaaagtggagtggatttatgaaaaaacggtggagtatactttcggctgtactttgtgtggcacttttgactggtggatgtggaactggaagcaagaatgatgcaggtacaggaaaagagcagacattcagtcatgagacaagggaagagaatgagcatcagagtaacctggatgttttacagccatctgcatatggcaatgtgcagggactgaatctggagaaaggaagctcgatttctattataggaagaggaagttcttccgcatactggaaagctgttcaggaaggtgcaaagcaggcggtagcggatattaatacaaacctgggatataaagggaatgataaagtaaagcttgtttattctgcgccggagacagagaatgatgtagatgatcaggtaaatattctggatgaggagcttgcacggtatccggttgcggtcgggatcgcagcagttgattcaggggcatgtgaggttcagtttgatcttgctgcagagaatgggatcccgatcgtagcatttgattccgggaccgattatcagaatattgtatccatgattgatacagataatacaactgccgctgcaacagcagcaagtaagctgtgcaacagtatcggtgagagtggtcagatccttgtaatcgcacatgactccaagtctacttcttctgaagaaagagagcagggatttgtacaggaagtggaaaagaatgatccgaatgtaacggttgcagagatctggcatctggatgatctggatgcgatctcaaaagagatcaatgcagattcatctgaaaagaattcccaggagactgcagataatgtgcaaaaagcagaggaagagaacgcagatagccgggatacccagacggcacagcaggatgcaatcaagtatcttcttgaaaagtatccggatgtaaaaggaatttttgcaaccaatgaaacagtagcagaccttgtggtgaatgttctggactctatggacaaaacaacaggggaagaccgaatcaaggtagtgagctttgacggcggggaggatcagatgaagcttctggaagatgggaagattgatgggctgatcgttcagaacccatacggaattggctatgcaacggttgttgcctgcgcaagagcagtgcttggtcagggaaatgaagcaatggtaagtaccggatatacctgggttacaaaagataatatgaataaagattcgattaagaagatgctttattagtaagaagaaatgtctgaaatctgtgggaaatgggtttcagacatttttatataaaaacggttgtgagtgacatattatttatgccggctacaaccgtttctttttatttcataggaaattccaaaggaacttcctatgaaataaaaggcactgcgtgccggggatgcgcactcgcacgaagatgaagaatgtcgcaagcgaccgcgctcggcgcgagaatgtgctgaggcacattctttcttattgctattttttcgtcagtggaagggagaagataaattctgttccaactccctcggtactgatcacattgatattttcattgtgtgcctgaataatttcttttacgatcgaaagcccaagtccggttccttttttgtcttttccgcgggagagatcgcttttgtaaaaacgttcccatattttgttgatacttgatttcggaatgccaattccataatctttgacggaagtatatactttgtcaccgcgcggtgtggtttcaatcgtgatcgtagactccggattgctgaatttgatcgcgttgtccagcagattgtatagaacctgttggattttgtgctggtcagcatgtacatacagggtacgagttgccagaagaagttcgatagaaatttttttggcagtgcaggtaccttcgaaagaagctgctgtgttacggatcacttcgtgaatatcaaaatctgttttatcaagaagaagatccttcgtatcaaattcattcaatgtcagcagatcgcgtgtaaggtcagtaagacgttctgtttcaaataagatgatatttaagtatttgccctgcatttcaggtgggatcgtgccatccgccatggcttcaacatagcctttgatggaagtcagaggagaacggaaatcatgggatacatttgccacaaatttcttctggtaatcctccatatctttcagttgggaagacatgtagttgagggatgcggaaagatatcctatctcatcctgcgtattaaccgggatgacaacatccagattgccggaagcatactgctttgctgcattcgtaatcttgacgagcgggcggtagatcagaaaatgtacacccagcaaaataatgaatgagagcacataaatgatcagaatcacgatatacgtgttacgcatcagaacagaatgtgcgtctgtgatctgcgagtaaggcttatgtacaagcagatatccgtgggttgaaaaattctctgtgaccggagcaatcacggtgatcatttctgagttgaagtacccgtgataatcaccggtcagataagtggagccgccggattctgcaggatcaaaattttcaatccgggaaggggcatacgatacatcgccggatttggcagatgcaagtaaagatccctcattatcaacaaaccagatatctgaattcagataatcgctcataccattgagctgtgtataaacatctgccagagcaatggttttggaaaaatagtccggcagataattggatgcaagcagattcgccgactgatacatattgccggaaatgctgctttccagatagtgggttgtcagtgtggatgacagggatgctactgtaaaaatacttaaaaatccgagaataatatataagaggataaatttaaggtaaagagtacttttcattacttcacctcaaatttgtaaccgattccccagacggtactaagtccccaggaaggatgatccttgatcttctcgcgcagacgcttaatatgaacatcaacggtacgggtgtcgccgacatactcatagccccagatctggtcaaggagctgctcgcgtgtgaatacctggtttggtgaagaggcgaggaaatacaaaagttccagttcttttggcggcatatctacattcttaccatcaacggttactgcgtaattggtaagattgatctcgattcccggatagtcaacaacctttccgcggctggcggcaggagtttctggtttggcaggctgatagcgtctgagtaccgcttttactcttgcgacaagctccttggaatcgaatggttttaagacgtaatcatcagcaccaagctccagaccgagcaccttgtcaaatacttctccttttgcggaaagcataatgattggggtattgtgcttactgcggatctcgcgacagacctgatagccatcgatgcccggaagcatcaggtcgagcagcatcaggtttggctgataggattcaaatgcggtaagagcttcttccccgtcgtgtacgatcatcgtatcgaagcattcctttgtaaggtagagagaaatcagttctgcaatattctcgtcgtcatctacaattaagattttctgtttagtcaccatgatagttccccctatgattatttgaattctacgatagttacaccggcatcgccctccccgaaagctcccagccggaaggatttgatatgtttctggcggcgcagatactgatggatcccgttcctgagtgcgccggttcctttcccgtgtacaattcgtaccggacttaagtgtgcgatataggcatcatccagatatttgtcaagttcggcaactgcttcatcgactgtcttgccaagaagattgatctccggactgacatgcatggatttgcccatcttcatcttgccactgctggttctgcgcatctgctttgcagtaaccgtaagcggttcttcgatcagttcgagatcggaaatattgacctgtgaccggagaatacccatctggacaaacagattgcctttggcatccggtagtgaatttaccgttccggtcagattcatgctcagtacttttacagaatcgcccagatggaaatcgcttgccttgtaagctttggaaggttttttcttttccagacggtttttattttcagttttggaaagctgcttgcggatccgttctctttctttttccatctcggaagcggaaatactggctttgccgaatttgcggaagttcttcattgtctcatcagcaaaatctttggcttcctgaacaatgtcggttgctctggcatttgcctcacgaatgatccggtcgcgctgtgtatccagcttttcctgttggttcttgagttcggacttgagacgctccatctcgcggcggtaagaagcaacctcttcccgttctttctcgatggtcttgcggctctgttccagatcagtaaggagatcttcaaaagattcatcctcctcggtcagatgcgttttggcatcctggatgatataatccggaaggccgagtttttcggaaatcgcgaaagcattactttttccaggaataccgatcagaagatggtaagtcgggctcaatgtctccacgtcaaattcacagcaggcattttctactcccggagtagaaagagcaaataccttcagttcgctgtagtgtgtcgttgccatagtgcggattccacggttatgcagatgtgacagaatggcgatagcgagtgcagcaccctcagtcggatcggttcccgcaccaagttcatcgaaaaggactaatgaattctcatccacatgatttaggaaagaaaccacatttgtcatgtgagaagagaaggtacttaaagactgttcaatactctgttcgtcaccaatatcagcataaacctggttaaatacagcaagttctgaacggtcaagtgcaggaatgtgcagacctgcctggcccatgagggtaaaaagccccacagtcttgagggaaacggtcttaccacctgtgttcggaccggttatgacgagaagatcaaaggtatctccaagtgtcagactgatcggaacaacttttttacggtccagaagagggtgtcttccctcacggatccggatccggccttcggtgttaaagactgggcggctggcgttcatatccagtgccagtgcaccttttgcaaaagtaaaatccagttctacaagtgctttgtagttcagacggatttcttcaatatattcagctgcatccacactgaggcgggcaaggatcacctggatttcttcctgctcctgggcatataattctttcagatcattgttcagtttgacaacggccatcggctcaatgaaaagtgtggatccggttgctgactggtcatggatcagaccatttacctggctgcggtattcggcttttaccgggagacagtaacggtcgccacgcatggtaataatggcatcctggagataggtacgcatggaaccgttcaaaagtccggtcatggtagaatggatcttgtcattcatgccgttaatactgcggcggatctgctttaatttgctgctggcatcatcgctgatctcatcttcaccaagaatgcagcggtcaatttcggcagaaagtggtgtaagcggcgcaagctgttcaaaatatacatccagacaatctgcctgatcgtctgcattttcatgacggccgtaggatttgatccgggcggttgtctgaagaagcttgccgatccggaggagttccggtgcgcttaaggcacttccgatctccaggcgcttaagagagtcggagacagcatagcagccgctgaaagaaggaattcccttctttacaatgcgggtaaatgctgcggcagtctgttcctgtgcagtgatgattttgttaaggtcggtcatcggcttgattcgcctgcagaatgaagctccgccaggggaagaagcgtgatcggtcagcatctctataatttttggaaattccaattttgttaaagatttttgattcataatacatttatacctcatattttgtctggttctattctaacttatttaccgtctaaatgaaagtggaaaggtgaaatttcgttgaacatttgcggggaatcatgtatactaaaaccaggtgtggctgaaagcactccggaggcctaaggagaagcacaatgtctgataatcgagagaataagcataacgaagaaccgcacgacagtgaggaagaaaaatattcgtttttgcaggaaacagtaaaagatgaacagcgaagtaaaaaaggaatcatgggaaatctgtgcaggcttgcaggaagaggactgatttttggacttgcagcaggccttgcgttttatgcccttcgcccatgggcgatgacacatctgggcggagagaaggtaacgattccgctggatcaggaggaaactccgattgagaatgagacggataccaagaatcaggaagcacaggaggaagagattcagtatccggatctgactgtcgaagattatcaggagatgaaccatgcattataccaggtggcattgtcagcaggaaaaagtgtggttgagatctatgccgtgcaccgggatgaaggctgggagaatgcaggggagcaggctgtatcgggagttattttctgggataatggagcagatcttttgattgcggcaccggcaagaattgtaaaagatgcagaagcactgaaagccacattttcagacaatactacatataacgcaactttgaaaaagcaggatcgaaatcttggacttgcgatcattgcggtcaagagatcagatctgtcggatagtacgaggaaccagatccagacggcgatgcttggtaattctaatgcagtgaaccgtggggacggcgtgatcgttcttggtgagcagtttggatatgcaggtggtgtcggatatgggatcatcagttccaccagaaattaccggacagtggcggacgggcagtaccggctgcttgatacagatattgcaggaagtgaaaaagggagcggaattctgtttaacacggcgggtgaagtgattggaatctgtgaccagtcagaactgcagagagacggaaatcttgtaagtgcctatgcgatttcggatatcaaggaagagatcgaacttctggcaaatggacagggagttccgtatattggcgttcacggagttgtagtgacggagaagcttgccggcgaacagggaatcccgaaaggcatttatgtcagggaagtagaggctgattcgcctgcgatgcaggctggaatccagaatggtgatgtgatcacagagattaacaagacagatatcaccggtataacaggacttcataaacagatcgcagaagccggaaccggtacacagatcaggatcaaagggcagaggcgtggcgcagatggttatgtcgatgtaacatttgatgtgacagttggaagtaaagaatagatttgcagataaaaagcaaccataaatttaaaatataaagcaggaagaggaatgacatgagatatattgagacattacacgaaggcgagacaatcagaaatacgtatctttgcaaagggaaaagaagtgcggagacaaggaacggaaaaccatatgacaatctgatccttcaggacaagacaggaactttagatggaaagatctgggatccgaattcaaatggaattgcagattacagcgaaaaagattttattgaagtttacggggagatcatcagctataacggcaatcttcagatgaacatcaagcagctccgtgtagcagacgagggagaatacgatccggcggattatatgccgaccagcgagaaaagtgtggatggaatgtatgaagaactgatgcgttatggaaagcaggtgaagaacccgtatctgcagcaggtgatccagtattattttgtaaatgatgaacagtttatcaagagcttcaaggcacattctgcagcaaagagtgtacatcacggatttgccggaggacttctggagcacacattaagcgtagtgaaattctgtgaatatatggcaggggcatatccgatcctgaataaggatcttctgtatacagcggcaatgtgtcatgatatcggaaagacacaggaactttccctgttcccggataatgattataccgatgatgggcagctgctcggtcatattgtgatcggtgtggaaatgctggatgatgcaattcgtgagatcccggatttcccaaagaagcttgccagcgaattaaagcactgtatcgtagcgcatcacggagaactcgaatacggttcgccgaagaaaccggcgcttgctgaggcaatggcacttaattgtgcagataatgctgatgcaaagatgcagacactgacagagatttttaaggcaaaagatacaaaggactggttaggttataaccgtctgtttgaatctaacttaagaaagaccagtatctaagagaagttctgaaagaaagatgagtataaaaatgaagaaaaatgacgtagtgacggtagaagttacagatatcggaatcggtggtgaaggaatcggaaaggttgatggatatactctgtttatcaaggatgcagtcatcggagataccgttgaagtaaaagtaatgaaagcaaaaaagaactacggatatgcgagattaatgcggattgtaaaagaatccgcatttcgtgtatctgcacgctgtccggaggcaagacgctgtggcggatgccagattcaggagatggattatcggaaacagctggagtttaaaaatacaaaagtaagaaataacctgatccgtcttggcagtgtggaagaagaattgctggatcagatcatggagccgatcgcaggaatggaggaaccgttccgttaccggaataaagcacagttcccgatcggagtggataaagaagggaatctgattgccggattctatgccggaagaacccatcagatcatcccggttccggacagggactgcgtacttggaataccggagaataaagtgatcctggatcagattctggactacatgcgggaagagaagatttctgcatatgatgaggaacggcacaaaggactggtgcgccatgtcctggtccggtatggatttacaacaaaagagatcatggtttgtctgatcattaacggggataagcttcccagcagtgaaaaattgttggaaaagctgacaaagattccgggaatgacaagtattacttataatatcaataaagaaaagacgaatgtgatcatgggatcaaaggtttgtccgctctggggacagacgtatatcaccgattatatcggtaatgtcaaataccagatttcaccgctgtctttctatcaggtgaatccggtacagacagaggtactttacggaaccgcactggaatacgccgggcttactggaaaagagacggtttgggatgtgtattgtggtatcggaacgatttcccttttccttgcgcagaaagcacagaaagtttacggcgtggaaatcgtgccgcaggcaattgaagatgcaaagcataatgctgagatcaatgagattacaaacgcggagttttttgtaggaaaggcagaagaagtgctgccggagtattatgcggattatgcaaaagagcatccgggagagcatgcgagagcggatgtgatcgtagtcgatccaccgagaaaaggatgtgagagaagcgtactggatacgatggttcagatggagccagagaggatcgtatatgtgagctgcgattcagcgactttggctcgggatgtgaagtatctgcgggagaatgggtatgagatcaggaaggtgaaggcgactgatatgtttccgatgagtgtgcatgtagaagtcgtgtgttgtctacatcgggtgaattcgtagaagtccttaatttccgcgaagacaatgaggagagttccgaagaaacaactggctgtaaagccagtgtttatgcggaatttgacgaatgtacgcgatctgagaatttcatagaaattctcagattcaggcaatttgcgaggtatatgagtttcacacccacaggcaaacaaggcaagaaaaagcagattatgaacggcatcgaagtgtcagtagtattgcatctggtatgaggaaacacattcggatggaattaacattttttattcaatagcatagaaaagaaccgaaaggacgcttgtttgcgggtttgcaggctatgcatttagagggcgttgccttttgcaacacttttgcaacaccttcattgaaaaagtgatttgcaacagcagtcctttatttcttcttccagctggcatctgcatcggtaccgatgctggggctggtccagaacggtgtaggcgccagtatcctgacaccgatcatttctctgctgatcatccttggagctatctccacagcagtaaatataatctccggtattgtgacccgctgtgtaaatgcagtggagcgccgtatggaccgctcggcaaaaaaagcgcaggaacaccttggaagaaatgcagttttcacagcgatctttacattcctggcatttgccatcgcacagttcggtctgatgacagttgttaaaaagggatatgcataccttggatatgcggcgtttattacattgtttgtaccgtttgttgtacatgccgttgcgacaaagggaaaagagatctgaagaataaaaagctgaacagaaaatcccccgttgatccgtatggcaggatcatcaggggattttgtcaaagttcacaaaaatattataaatattttattaaatattccagatagacaacatatattttttctgatattattatacacagttattaaatagttacgaatcagaaggattgttactgaaatatttatttatcgtcaggcaagaccttatagtagtataggaataggtttgggataggttttctatatactgtaatggtcttttttttatttgtctggcagcgggggaacaggaatatggttatctataagattttgaataataatctgatactgtccagggatggacagggacatgaagttattgtaaagggctgcggaattgcctttcagaaaaagaaaggacagcaagtggaggagtccaggatcgagaagatctttactgcggaaaatgcccagatcagcaaggagatacagggttatctgactgctattccggaaaaatatctggactttgtggaagcttttgtaaatgaagtgaaggaaaagaggggatgaaattaaatgacagtatttatttttcccttagcgaccatatcatgggtgcgatctccagacttgaaaacgggatccgccttcagaatatgctgcttctggatatcaagcagctttatcataaggaatatgagatcggcttggaattactgaaaaaggtaaatgagatgttcgaggtagatctttctgcagatgaagcaggattttttgcattgcattttgtgaatgcggaagatggcggcaagacggacagctatcagatttccattatcgtacatcagatcctggacatcgtggagaagtattatgacaatatggaatttcaggaggataatctgtattatcagcggtttctcacgcatctgaaatattttgcccagagatttcttcataaagagcttcactatgatgagaatcaggagcttttcaagatcatcaaggagcagtacaaagaagcttacggctgtgtaaaaatgatctatcttatgatggaagaggaatataaatacgctatgactgaggacgaaatgctgtatctgacgattcatatccagaagatcacagaagaccataaacgtctgaaaaatctgtgaaaagagattgttttataaattaggtgttaatggattgttactgaaatacgtgccatgtgcgtatcttttcaggcaagacctttaatataaatttcaatatttattattaaaggaggtccccaaatgaaaaaggactatgcaaaaactgcagacacactgattgcagcgctgggcggaaaagataatatcacccgtctgttccactgcatgacaaggcttcgtttctatgtgaaagacagatcgaagatcaacgagaaagagatcttaaagctttctgagatctccggcgttaactggcatgaagatcagttccaggttatcgcaggaaacgaagtaaacgctgtttacaaggcattggaagacaaaggcgttcctaccgatgatgcaccggcagcgaactctgacagctcaaagagtgttgtttcaaaagttatcgatgccatcaccggatgtatgaccccgatgatccctgccctgactgcagccggtatgatcaaagttgtacttaccctgctgacaacttttcatctggtatcagaaacaagcagtacctatcaggtgatcagttttatcggagatgttactttctacttcatgccgttcctgatcgcagcaaatgctgccaaggtttttcgcgtgaaccagtcactggcgctgtttattgccggtgtttacttaagccctacctttgtaaccatggcagctggtgatgcggccatcacactgtttggtctgccgatcacaaaagcaacttattcttattccgttattccggttatcctgatggtatggatcacacattatattgagattctggttgataagatcacaccgaaaatggtaaaactgatcctgaacccgacactggtaattctgatcagtgcaccgatcgccctgatcgtagttggaccgatcggaacaattattggtaacggacttgcggtagccatcaacttcctgtccgtaaaacttggtttcattattgtaggtatccttgcagcaaccttcccgttcattgttatgaccggtatgcaccatgcgctgacaccgatcggactgaatgccattgcaaccggtggtgccgatacactgatctttgtatctcaggtatgctctaaccttgcacagtccggagcttctcttgcagtagctgtaagatccaaggacagcaacatgaaacagctggcaagtgcagccggtgtttccgctcttatgggtatcacagagcctgctctgtatggtgttacactgaaactgaaaagaccggttgtagcagcttccatcgcagccggaatcggtggtatcgtaggaggacttcttcaggtttctctttacattgcacagaattgtatcatggcgatcccggcgtttatcggcgagaagggattaagcaatctgatttatggaatcattatgatcgcggtatcttttggagctgcttttgttcttacacttatcttcggatttgaggatgtaaaggctgagacagaggatgaagtacagaacacagatacagaaaaacagccggcacagcagaacgctccgcttgtagataagatcgagctttgtgcaccggtagcaggaactgtaaaagcactttccgatgttccggataaaacttttgctgataaggttttaggtgacggagcagcgatcgttccatcagaaggaaaggtttatgcaccggcagatggtacggtggcaaatatcatggagagcaaacatggaatcatgtttgtgacagaaagtggagcagaaattctgatccacatcggacttgatactgtaaatttaaatggtaaatattttaaatcccatgtttctgatggagataaggtaaaaaaaggaaagcttcttgtggaattcgatatggatgccattaagaaagaaggatatgatctgatcacaccggttgttgtgaccaatatttctgattatatcaaagcagtatgcatggaaaaagaagatgcagctgtaaatgcaggagataaatttctgactattgtataagaataacaacgaaacatcaggcggagataacagatccgcctgatgtttgtaaaaaggagaaaattaaaatatgaaaaattataaccgtatgccggaaaactttctctggggcggagcaactgctgcaaaccagtatgaaggcggttgggatgaggatggcagaggcccgtccattgcagatgtcctgacaggaggaagtgtggataaggaacgtcgtcttacaccgccggcaccgttaccggaagaattttatcccaatcaccaggcaactgatttttatcatcactggaaagaggatattgctctttttgcagagatgggatttaaggtatatcgtttttctatttcttggtccagagtgttcccaaatggggatgaggaaactccaaatgaggaaggccttaagttctacgacaatgtgatcgatgagttgagaaaatataacattgagccgctgataacgatctctcattatgagaatccccttcatctttctctggagtatggcggatggaaaagccgtaagatgatcgatttctatcttcgatttgcaaaggttttatttgagagatataaaggtaaggtaaaatattggctgacttttaatgagatcaatatgctgacgcaggactttggtgcggtattctgtgcaggaatgctggacccgaaggatgtatgtgagcagagccgttatcaggcaatgcatcaccagctggtagcaagtgcacttgcagtttccatggctcatgagatcaatccggagtttatgcttggctgtatgcttgcttatcacaatggttatccatatacctgccatccggatgatgtcttatatgcacagcagtttgggcagatccacaattccattgccggtgatgttcatgtaagaggatattatccgggatttgcagcgagatactttgaggagcacggaatccagctggaggttcttcaggaggataaagagatcctcaagaagggtacggtggactttttcaccatcagctattattccagtagctgtgtcagcgtgacaaaggacggagagaaaacggccggaaatggaagtgacaatctgaaaaatccatatctgaaagcttccgactggggctggcagatcgatgcaactggtcttcgctatgttctgaaccagatctatgaccgctatcagattccgatcatgatcgtggaaaatggtcttggggcggtggatcagctgacagaggatggaaagattcacgatgattaccgtattgaatatatgcgccgccatatagagcagatgaaggaagcaatccatgacggagtagatctgatcggctacacctgctggggctgtacagatcttgtcagtgcctccaccggagaattcaagaagcgttatggtcttatctatgtaaataaaaatgatgacgggaccggagacttttccagaatccgcaaagattctttttactggtacaaaaaagtgattgaatcctgcggggaagagttttaaatgaatcaactgtgaagcagttatctggtgtagaattatgtagcgaatgcggttgcttttatccggttgacgacaaaatcctggagtatgacaatgtactccgggattttttgggaaggttgaattttacacggtaaagtgtaacacttattgtaagtgactaggtaattgcgaaactcaaatttgaaatatgagagcagttatccacaataaatggagatgataaatgcagaaacgttaaatgatgagatattttaggcacacttaaataagccataggtcttattaagttggtaagtcctatgctatgagaggctttaagctttgaatatattcgtggtgattgatcttatctgcgagaacaacagtaataagttgggtgataccggcaagaatcagatcagcatacagagtcttctcattttgggttcggcgtcctgcaagacagagattgtctttgatgtggttgatatccctttcgacaacagttctgattttataggtatcatcccattcttcggtgccacggatcgttccgggataagcacgaagatccttttctgggtagatgtagaccatccgcccacatttagaagaggtacaagggttgtcacagaaacaatgacgatgggctttttgagttggtttatcataaatccatttcatttttggacagacaaatttatatttcgttactccactgcgaagtttggaagtgccttcgtacttcatttgtaaagaaggatcatggggacaacacggaataccatcttcattgatagaataatccagattttcaagtccggatcttgcattcagcggaatataagctttcgagaaatgtttgccattaccaaaagtgtcattggtaagaaggctattatagagctgtgcggtatcgaaagcagcatcacccaggaaggtttttggattgatcaaaggatgcttggaaaagaagtccttcagtgtcgggattaaaagctttgaatcatgaacacatttatcttcgtcaggggaatcggatttcttttcgacaacgatatcaggatgtgaagccataaattttttgttataaaaagatatgtggcggatgatgcccagtccgttggtgacaatgccgaacttgaagacatagcaaaaatgcccgtcgatgcatagaaatgatttctgaaagaaatcggaataaactcatcaatatcgatatgggtttccaatagagaaagaaacgcaggtttgtcattttcaaatttttcctggcaatctgaaaaaatatctgcccaagaaagcagtttatatggtatcataagtatcagaataactcctttcttggatgtaggtttatagtttttagtcaactcgattataccatatccggtgaggagttatttgcttttaggtaacaaaaaatgccgtatttatgcggtgttgtggcgtttcgcaaacgcctaaatagttaataaagagaggtgcatatgctatgccaggtatactcgtggttgaagatgatgaaaatttaaatcgtggaattacattttcattgaaaaaatccggatatgaggttttttcagcagaatcagtgaaaaaagcgaaaagaattgcaagtgataataatgtggatgttaccatttgtgatgtgaatcttccggatgggaatggactggaatttgtaaggtggatgagatgcaattataatacatacattatttgtcttacagcactagatcaggagatggatcaggtcatgggatatgaagcaggggcagatgattatattacaaagccgtttagtctttcggtacttcttttgaaaatagaagcacatttccgtcgcagacaggagaaaacggaagccggaaagatgatttcgggagatatcgtatttatcgcaggagaaatgaaagtcctgataaagagtcgtgaaatcagtctgacaaaaacggagttgaaaatgctgactttttttcttcagaatccgaaacagattctttcaaaaacacaaatattggaaaatgtgtttgatctggaaggggattttgtggatgaaaatacaatcgctgtcaatatcagaagactccgtgagaaaatcgaagacaatccggctgcaccggtctatataaagaatatcagaggtcttgggtatatatggaatcaggaagtaaggcagtgacaaagagatatcgcaagaagattacagtagtgatctccttggtattacctgtcatattattgtttgcaatattaaattgctttaccacgtatgtgttttatgaagattataaatataaaatgaatcttatgacagagattgctgcaaaggaagaattttccgggctggatgttgtttcggaattgcttaaggataaggatattgaaactaacgaacagggaaggcgattattggagcaatatggatactgggggaataaagggaatgcattttattcgcaattccggcatcaggttatggtgaccggtgctgtaagcactgtgatatgcgtgcttcttttgacttttttattttattggaagaaaaaagaagatgcgtgtcatcagaaaattttagaccagttggaagaaattctgatcagattccgtgaaaataaatttgatgatttactgaaaacggaaaatcatgcagaactggaaaaattgaatgaccagcttgaagcaatcggacatcatattcagttgctaaaggaagaagcacgggcagaaaaggagaacacgaaagaaatggtttctgatatttctcaccagttaaagacaccggttgcagctttggatacatgttttagtgtgctgatgcagaatgacttaagtgccacagaacaggaggagtttcgtatccgttgtcggagtgctctggatggactggagacattattgcagtcgcttcttgaaatatccaagatggaaactggactgattcagattaataagaaaaaacttccgcttatggatactgtcatatctgctgtgaaccgcacttatcctaaagcggatgagaaagaaattgaattcgtttttgactatgaaaaagagctggaaacatgcacgattatgcaggataaaaggtggcttggtgaagctgtgatcaacgttctggataatgcggtcaagtacagtccgtgtggttcaaaaatatttatccggttacaaaaaagaaacgatcttgtaagaatggaaattgaggatcagggaattggtattccgcagaatgagtatcacaaaatttttcaacgattttacagaggaagttccaaggaggtcatggaaaagagtggtacaggaatcggactttttctatcgagagaaattatcgaaaaacacgcaggtacgattacggtaacctccggcaaaaagaaaaaaggaagcatgtttgtgattcaattaccatatgttggttaaattttaattgggcagaaatcttacaattctgtaagacttctgcccactttttgaaagtgaaatgaaagattatattgctacaatcagcatgtaggttgaaaaatgatatataaacaggcaaagaaagtgtgctgaaaaggtacgctttacagaattgaaaaggaggcaacacatgagtgtgatattagaaaccaggcagctttgtaagttttatggtgcaggtgagaatcaggtcaaagcggtcaatcaggtggacattcagattgagcagggagaatttgtcgcaattgttggaaagtcaggttccggtaaaagtacattacttcatatgcttggagggctagacaccccgacaaaaggcagtgttactttagcagggaaagatttatacaggatgaaggaagatgcccttgctgttttccgcagaagaaaaatcggatttgtttttcaggcatttaatctggtttcatctgttaatgtctgggaaaatattgtactgccactggggctggatggaagaaaagtggatgaagcgtatgtaaatgatattattgcaactctggggattgaaaaccggatttataatctgccaaatcagttatccggaggacagcagcagagagtggcaattgcaagagcactggtgaatcgtccggaaattatatttgcagatgagccgacaggaaatcttgattccaagaccagtgatgaggtgatcgccctgcttaagatgacagcaaaaaaatatggacagacaattgtaatgattacccatgatgacgaaattgcacaggtcgctgaccgtattctggtgattgaggacggacaggtggtggatttcagatgaagacaataagcaggattgcatatagcaatgacaaaaagaacaagacaagaagtatactgattatgatgtccatatgtctgaccacgatgctgcttgtgattatcagtactatgggaaatggaatgatacgtttgcagaaaagtcaagcggcaggctcatatggaagcaattatggtttgtttgtcgcagcagacggatcgcagttaaaggaagtaagccgccgtgcagaaatagatgcaataggaattatgtgtacagaaggcatcataaaaggcaatgaaaatggcgggtttgtctgcatggatgagactgcaagaaaaatgcttccctataataaggaatatgaattaaaggaaggaaagtatccggaaaaaatgcaggaaattgccgccggaagagcgttttttcgtgcaatgggatatgatgatgtaaaggtcggagatacggttacactggattaccgtgcagggatgcggtcagaatataagccggaagagtttgttgtcagcggaatcctatatgaccgggatgagtataccatcgaggcatcttatgttgcttttgggtcacaggagttttatgatgagcacgtcgcagagaatgacagacagtataatatttattttactttaaatgattctgcaaatgtatctatgaataatattgaaccggttataaagcagattgcagcatcttgtggaatcgaagaaaaaaatgttataatcaatgatttctatctgcaatgggtcttgcagccgagttatgaaacgattgcggtatgtggaattctgattcttgcaattgtacttttctctgttgtggtcatttataatatttttcaggtcggtattgtcaacaagatacaggagtatggaaaaatcaaggctctgggagcgacaaaaaagcagatgaaacaactgatcttcagagagggcatttttttgacatttttttcaataccggttggattgcttcttggttttctgattgcaaaatgcggttttaactggctggtagaacagggaaaccttgtatcaacccaaactggttctatgggagtccaaaatcagcaggtgccactgttttccctgcctgttatacttctatgtattttcgtatcatttcttaccgttgctttggcactgcgcaaatcaatgaaaattgtttcaaggatttcacctatcgaagcaacacggtatttagaaaatgcagaaacacacaaaaaaggaaaacgaaatggcagaaaaaatgtcaccgtgttttctatggcaatggcaaatataacgggtaatccaaaaagaaccattggtaccatcctcacactggggctttcctgcgcattgtttgtgattatctctaattatgtaggaaatattgatacggagcatgaagcacgtctttccgttaatcatggacaatttgaactgcagcttgactattctgctgagtacgatgaaagatatccggagaataatctagatacgattctgacggataatccattgaatgattcgctgattgaagaaatcaaaagcattccgggagtaacagatgtcatgacgagagagattgtctctgtaaatctgaacggaacaagatttccggctgatattgtgagtaaaaaggattttgattttatgcgccaagaaggggatattggctctatggactatgatcaggcggtaaagaatggtgatattttctttggctggtcaacgtggatggaacaagatggatatgctccgggtgaatctattgcatttgactttgagaatggaagtggaacctatacctatcagggaaagattgcaggatcctttgtaagcgcggacacttatcttgtcattccggaaggtgtatatcgttccatgaatccgaggggaacagcctatggctatctgtgggtggactgtgataaaaaagatgtggcatctgtagaacaaagtctgaatactttgatttctaatacttcgcatataaaaatggatacttatcatgcgcggttacaatctgccgaatttgcaagcagcatgatgaagcttggctgttatctgtttatggcaattgtcggtctcattgggtttatgaatctggcaaacaccatgatcatcaatatcaccacgaagaagcaggaatacggtgtgctgcaagcggtaggcatgaccaataagcagttgaatctgagcttacaaatacagggcttgatttttacggttggcaccatctgcgtcgcacttgctgccggtctgccccttggctatgcactgttttcctatgcgaagcataatgggatttttggaatgaacgtttatcacgttcctcttatcccgattcttgttatgattcttctggttggtattttacaaattgtgctttcctgtgttttaagcagtaatctgaaaaaggaaacgctggtagaaagaataaggtatcagggatagcatatcctcagtatcataacaggaattaaaagcacttggctttaaaaagttttgtacttttgacaaaatgcaaccgatataagttttttgaaaactgtcgtttggtaaaatctattccatttttaaaagccttgcgataaaatatgttctgtgagacggttgttttactttccaagggaatggtcgacagtagaaaagtgaaggtggacttctttctggaggatatggatttatctgaattcaagggaaaagcaacttatgagcagataaaggcatatgtactggaacagacagaacttaaggtttcatcactgtatatcgcacagattaagaagaagtgtggattagatgtcggtgagaacttcaatccggctaaatcagagaatgcgagacagccacagtgtacaccggagaaggaagatgcgattatgcaggcatttagacattttggaatcatatagagtgtggataagcagtatcatgtgttaaaaatatagtgaagtatggaaaaaaggacattccggaactgtagattttacaggtcaggggatgtcctttttgcagatatggaagtgttcaagggacaaggtaataatactgatgtattaagactgatttgagagatgtgtggatgttgtgacagcactgatcttaaaatatggaccggcaataaaaagaaaatggattttacgtgattggataaaaaacatacaggctgactgcttttggagaagtttagcctgtaaaagatatcagcggtatttcgattgtatgaaagctattgtgaaaaatgatacgacatgacacaatcggattgactaaagcgacataggtatttataatatagacaaaacgaaaatgacataaacggaggacagagtaatggagaaaactgtaacacttgaagaggcattaaaaagaattgaggagttggaaaaagagaatgcagaacttcgggaggaattggagtattacagaaatcgtaagttaagcggtcgtcagaaacataacgccaagtggatggcaatttataatgattttgttgttggatatgagagcggcatgacgatggtagaaattgcgaagaggaacaatgtcagtgagcggacgatttataggtataaagcgtattatgacaaactgagggaaaaagaggaatagaccattttactgacgtcagtaaaatggtttaatgtgggaggagaaagtctaatatggaaaagaaaatgataatgaattataagaaaagatttgatgaaattaggcatgaagaaaacggagttgaattttggtatgcacgtgaattaatgcatttgctagattattcaaaatggcaaaattttgaaaatgttttattaaaggcaaaagttgcttgtgcaaataatggcattgtagtagagaaccattttgctgatgccagtaaaatggttattctgggaagtggcgcaaatagagaagtagaagattatatgcttacacgttatgcatgttatcttattgcagagaacggagatcctcgtaaagaacagatcgcttttgcacaaagctattttgcagttcaaacaagaaaacaggaattgatagaagaaaggatttcttatattgaaagaactgaggcaagaggaaagcttcgagaatctgaaaaacgactgtctcaaaatatatatgaacgtggagttgatgatgctggatttggacgtatccgatctaagggggatcaggctttatttggaggattcactacaaaacaaatgaaagaacgtttaggagtgcaagataaaaggccgcttgcagattttttaccaacacttactattgctgcaaagaaccttgcaactgaaatgacaaattataatgttgaagaaaaagacttacagggtgagacggctattactgttgagcatgttgaaaataatacgtcagttagggatatgctggggcagagggggattaagccagaaaatttgcccgcatcagaagatattaaaaaattagaacgtagggtaaagagagaagaaaagaagttagctgagcagtcgggaaaattgacaaatgaataaactggaaggttaggttattgaaaaagaaaacaaaatgctacatatatactcgtgtatcaacagcaattcaggttgatggttacagcttggatgcacagaaggacaaactaaaaaaatatgcaaaatttcaggatatctactgccatgcaggtggacgcgaacatgaagcaatccttagtgtagaagactggaaaactgcatagaaaataagaaaaagaactggtgttaaaagaataaagacaatcaattaacacaagaggagtttggtaaattatttcatgttaccaggcaaactgtttcaaattgggaaaacggaaaaagttatcctgatttgcaaatccttgtaagcatgagtaatcaattgttatgacgccgactaaatggattgaacagaatataaaatgtagtctttttcttttattccatatagctcgcacccagtgctctttaagataaagtagaaatagtgcaattttcacatgatattatacaagaattacatagaaatatatcgtattattgatatggtattcttgaattgtatgtgaggagaaaaactatggcagcggaaagaaaaacattaacacagctatctgtgccaatatgcttagaaactttattttatatgctttcaggtatggttgatacgcttatgctatcatctgtaagtgatcaggctgtaggagcagtgggaacagcaaatacatatataggtgtttttattattatgtttggagtaatatcatcgggtatgatagctgttatgtcacaaaatatcggagctggaagaccggggatagcatatcaggcaagacaacttggacttatattcaacgcattgataggtatcgtaatgtctgtcattcttgctactttttctggtgggatacttcgaagcgtaagtattgctccggctttgcttgagccggctgaaatatatcttagaattgttggcggcacatgttttttaaatgcactgattcctattttctccagttatttgagagtgtttggatatacaaaacattctttgataggaactgttgttggaaatgttctcaatataatacttaattcagtatttttatttgcattcaactggggtgtgatgggagttgctgttgccacggttatttcgagagttgtaaatcttattattgtagccggcatgggggctgtacttgtaaaagcaaagcagagtcctgagcgaattacatcaagaaagatatttgcacagattgttaagattggttttccttctgcgcttgaaacagcactttacaacatcgcaatgacatttatagtgcgttttatgaatcagatggatgtggatggaatgaatgttacagcgcgttcatatgcgatacagattgcaaatttctcgtattgcgtgggagctgcccttgctcaggcaaatgcaattatgaccggctggagaattggagcaaaagagtttgaggaatgtaacagggggacgagaaaagctgcgatatatggtatcatcacagcgacatgcttttccgtgacctttgcatttgccggacattttatcgtgcatatatttacggatgatatacagatgataaatcttgtggtaaagttgttaatagtagatatatttcttgaacttggaagggtaacaaaccttgtatatgggcaggcgttaaaaacgagcggagacgcattttttccggttatattaggtgcgatatttatgtatttgtttgcagttggcggaacctattttctcggaatacacatgggacttctggctgtaggagcatatattgctatggcaggtgacgaatgtgcgagagcagtgggaatggtacttagatggaagagtggaaaatggaagagtaaaggtcttgtagaagtataggagagagtatgtactttgaattaaaggaaaataaaccacatggtacaaaggatgatccgtttagtacatatcatataaaaaatgaaggacgatcatttcagataccggttcattggcatgatgaactggaaattatatatgtaaaaagtggttttttgactgtaagtatatcaggagaaaattatattggaatccccggggatgcttttgtagtgtcgccgggtaatctgcattttatgggttcacagactggtacagtggattattttactttcctttttccattaaaatacatatctttttgcataaatgacatgttggatgataaattactggagccgttaaaaaatggtcatctgatgataagtccaagagtaaaagatacagcaaaagaactatgtgagcagttggttgaaatatatatggcaaaaaacaagaaaactgagccccaaataactgctcagataaaaacaaaaataattcttttacagtttattcttgaaatgtgggagaagggctttgtaatcgaaaatgataaaagcgggagaaatactgtagaaaaagaaatgatttcatatatacagcagaattttatggaaaagatatcattaaaagaatttagtgagcagtttcatctttcggaaaaatatatatcgcgatattttaaggaacattttcatattaccctttcgcaatatataacacatttaaggttagagcatgcaaaacagctgttacaagatacggatattcctgttacagagattgcaatgcagagtggatatcagaatgtaagctattttatcagaagcttcaaaaaaacatatggagtttctccgttaaaatatagaaaaaaataagccaggtatatggttagaaaggagaggatatcccggtagaatcagaaaatctgccggagagatatcgagaatgagtatgggaaataagaataaatggtggaaaaatgcagttgtatatcagatttatccgaaaagctttcaagattcggatggagatggaatcggtgatattccaggaattatcagcagattggattatttgaaaaaacttggaatagatgcaatctggctctcaccggtgtatcgttcgccacaggatgacaatggatacgatatttcagattatcaggatattgagccgatgttcggaacaatggaagatatggaacagttatttgcggaggcaaagaaacgcggaatccgaattatgatggatcttgtgctgaatcatacttcagatgaacacagatggtttatggaggcaaagaaaagcaaagacaatccgtatcatgattattatgtgtggcgtgacggagaagaaggtatttacccaaatgatatgaattctgcgttcggaggaccggcatgggagtgggttccagaactgggacagtattattttcatcagttttcagtgaaacagccagatctgaactgggagaatccgaaagtgagaagagagctctatgatatgattctctggtggatggaaaaaggagcaggcggatttcgtctggatgtaatcgatcagattgcaaaagagccagatcttaagatcacaaataatggaccaaagctgcatgaatttctgcgtgaactaagcagagaaacatttcagaagggggatatgatcactgttggagaagcctggggagcaacaccggaaattgcaaagaaatatagtaatccagatggcagtgaattttctatggtttttcagtttgagcacattatgcttgatcaggaagaaggaaaagaaaaatgggatacgattccattgaatctggttaagctgaaaaaatgccttgcaaagtggcagaatactttatatcagacaggatggaacagtctgttcatgaataaccatgatcttcctagaatcgtgtcgcgttggggaaatgacggaaaatacagaaaagagtcggcaacaatgctggcgacaatgcttcatggaatgcagggaactccttacatttaccagggagaagaactgggaatgacgaatgtgcagtttgacagcattgaggaatatgaagatattgagacattgaatatgtacaaagagcgtctggaaaaaggatatcagccagaagaaatcatgcagtctatctacgcaagaagccgtgataatgcccgtactccgatgcagtggagcggggatgagaacggaggattcacaacaggagaaccatggtttgccgtgaatccaaattataccagaatcaatgccaaagaggcactggaagatgaaaattcggtattttactattatcagaagctgattcgtttaagaaaagaaaatccagtattcgtgaatggaaaatttgaacttcttctgccggaagatgagagaattttcgcctatacgagaacagatgagcatacaaagatgctggtatgtacaaactttacggatgaggaagttagctgcccattgcttgatgagtggaaagccggggaagtctggatccggaattatgaggacgacagagaaggaaatatattgcgtccttatgaggcggtgataattgcatttactggcaaatagattgagtttctttttggcatcaaaattcacttactatatttcttcctgccacgctcatcaagaaagaacgcccattctctcttgaggtatttcggcatacggggcatagaggacacctcctttgtgctgcctaattgccgatttgctcccgaaacgcagaaacgcccaaaaccgtttcccgctgtatagttccgggacgattttgggcgttttctttcgatatgagcggctttgttttgacggcggtatcctttaccgccaaccattcaaaagccgctgtttgtcacttccgggtaacaaaaaagcgccgtattgctacgacgcttttgtcttgctcggcttattttgttgctggtgtccttggcataccactcgttcattatgctgaggaacggggtgaagtcgttatcctgcggcttgtcactggccacgctgttattgattgcaataaagcgtatctgcttcttggggaacagaatctcggtataaaagccgacctcaagatagtttctgcagaaacggctcatatccttgacgataattgtgccgattttcccggcttcggcttctgcaagcattgcctgaaatccgggacggttgaagttacgccctgtgtaaccgtcatttttcaaaagattgtttgtaaaaaatttgtaattctaaaaattcatataaactgtaatctatgttattctatagaaaagtaaaaatactgatgaagaaagcaggaggaaatttatgaacattgaattaagtattttggattggatccagacgttgcatacgccttttctggataaaatcatggtatttatcacaagacttggggatgcaggaattatatggattgtgttgagcatagtattgcttctgattcctaaaacgagaaaaagcggtgcggttatggtggctgctttagtagtagatgtagtactttgcaatattgtcttgaaaaatcttgtagcacggacaagaccatatgatgtgaatacaggtgtacaccttctggtagcaaagcttcatgattattcttttccgtccggacatacggcagcttcgtttgcttcggtaacagctttgtacctggcaggtgaaaagaagctttggaaatttgcgcttgtgctggcatgtctgatcgcaatatcgaggttatatctgtatgtacactatccgacagatgttcttggaggaattctgttcggtgtgatttcaggatatttgggatatcgcaaagtattgaaatgaagatgaccaaagattaccgaccgggaattatatggaagtcagttggtataagcatcattttacatgaattttacaaaaacagttctttaagaaggtagatatgaaagcgtattcagatgtataattaattcttaagcgtagctataaaatattcaaattagcaaaaggagataagtagacaaatgaaaaagaagcagttaaaaccagaaccatatatgatgaacagggaactgtcatggttaaaatttaatgagagagtattaaatgaagcagggaatccgagagtacctttagcagaacgacttacttttgcgtctatttatcaatctaatctggatgaattttatatggtgcgggtaggtacactgatggatcagatggaatcatcggaagtagtccgtgagaataaaaccaatatgaccagcaaagagcaggtaaaagcgatcattgatgcaacaagagagcttgatataaagaaagcagttatttacgagcagttaatgggagaactagagccgcagggaatccggattatcaatttcaacaagctttcaggaaaagaaggggaattactggaaacttactttgataatgaaattgcaccatatctgtctgcgaatatcatcagcaaacagcagccgtttccattcttacagaataaagagatctatgcggttgcactgcttgcaacgaagggtggaaagacaaaaactgcgatcattccgtgtagcaataatgtgtttaagcgtctgatcgatatcccgaccagaccgggaacctttatgctttcggaagaactgatccttcattttctgccgaaattatttaaaaaatatgaaatcaaagaaaaatctctcctgagaattacgagaaatgcggatattgatacagaaaccatttatgatgaagatatggattacagagacgccatggaaaatctggtaaagcagagaaaacgtatgaatcctgtccgcatggaattctccagaaagatcaacaaaaagctgatcgcagagatatgtaaatatatccatatggataaaaaccacgtatttatgtcgagagtaccacttgatttatcatttgtatttgcaatccagaattatctgagaatgcaaggagcagaaaaggaaaagctgttctatcagaagaggagtccgcgaatgacaccgcagctgaaagaaaaagaaagtctgatcgcacagattgagcagaaagatgttttgttatcttatccatttgaaaatattaaatcatttaccaacctgctttatgaagcggcaagagatgattctgtagtgtccatcaagatgaccttgtaccgtctggcagttcgaagccagatcgtagatgctttggttgaggcagcggaaaatggcaaagaagtggtggtactggttgaactccgtgcaagatttgatgaagaaagtaacattgaatattccagaaagctggaagaagcaggctgtcgtgtcatttatggactgagtggtctcaaagtacattccaaactttgtcttataacaagaaagacagaaaaaggtcttgaatatatcacgcagattggaacgggtaactataatgaaaagacttcaacattatatacagacttgtcgctgatcactgcgaagcaggaaatcggaaaagaggcggcggaagtatttgcctgcctgatgcgaggtgagacgatagaggaaacgcacatcttgctggttgcaccgaaatgtctccagaataaagtactcgatatgatcgatgaggaaatacgtcacgcaaagaacgggaaagatgcgtatgtcggaatcaagatcaattcactgactgataaagtgatcatcgagaagcttgtggaagcatcacaggagggtgtgaagattgaaatgatcgtccgtggaatctgctgtatgattcctggtatcaaaggatacacagaaaatattaaagtaatcagcattgtcggaagatttctggagcattcccgtatttatcgtttcggaacgccggacagagaaaaagtgtatattgcatcggctgattatatgacgagaaatacgctccgacgtgtggaggttgcagctccggttctggatgatacgttgcgtgaaagactggactggatgtttgacaccatgatgaaggatgatgaaaaaggaaaagaactgactgcagacggcgattatgtagatcgtgatatcaatgaagaaaagctggattcacaggaagtgttctatgagacggcatataaaaatgcggaaaagaaatagtagagaatatttgagcaaaataaacacagctgtagaaatgatacagctgttataaaatcagcagatacagttgacaaagagggacgtttgtgatattttaattaggtcgcaaacgtcatgggggattagctcagttgggagagcgcctgccttgcaagcaggaggtcacgagttcgaatctcgtattctccactttataagaagtgcagcagagaaatctgctgcatttttgtgtgctaaaaatatatcatcatttccatcttgcagagaaaagaaaaaaagaggaaaataaaatcatagtaaaacaagatggtatgattaccagaaaggaagattttatcatgaaagaaaatttaaaagtacttatgctcaacggaagcccgaaagcaaatggtaacacagccattgcacttcgcgagatggaaaatgttttcaaggaaaatggtgtagaagtagaaacggttgtaatcggaaatcaggcagtccgtggctgtattgcctgtggttcctgctgcgaaaaaggcaaatgtgtttttgatgatgtggtgaatgagatggcaaccaaatttgaggcagcagatggtcttgtaatcgcaagtccggtgtactatgcgtctgcaaatgcaactctgatcgcctgtcttgacagactgttctacagcagtcattttgataaaacgatgaaagtgggagcaagcgttgcctgtgcaagacgtggcggatgttctgcgacatttgatgagctgaataaatattttaccatttccggaatgccggttgcatccagccagtactggaacagcatccatggggcagcaccgggagaggccgaaaaggatgaggaaggaaggcagacgatgcgtacacttgcaagaaatatgactttccttatgaagagtattgcacttggaaaagagcagtttggacttccggaaaaagaagcaaagattccgacaaattttattcggtagaacaagtaaaaggcagggatttgtgaaatatcacgaatccctgcctttagagttgacagtccaactttcttgttttatagtgggagttgcaatttggtaggaagtatttaaaagagaggttttggtcatggcacttataaaatcaatcattattttgattatagggtttgctctattgatgaaaggagcagattattttgtagaaggaagttcttctgttgcgaagcagcttcatgttccatcgatgatcatcggtatgaccatcgttgcaatgggaaccagccttccggaatgtgcggtcagtgtaacggcatccctgacaggaaataactcacttgcggtaagtaatgttgtcggatcgaatattttcaacttgatggttgtttgtggagcctgtgcgttatttgcacctcttacgataaaaaaagatacattgaaaaaagagtttccattatcaattatctgtgcggccttgctgatggtgcttggatatgtcgggatgcttttaggacatttagatggcggtgtatttctccttatttttgcagcttatctgatctggatgattggttctgccaagaaagcaagagcagcacacaaggaaagtcagatgatgctcgaagagggagaattagtagacgaagaaattcagatcctgccactttggaaatgtgcattatttattgttggcggcatgatcgcaatcaagtttggcggtgattttgttgtagacagtgcttcagcacttgcaagcgcattcggacttagtcagacacttatcggacttaccatcgttgcgatgggaaccagtcttccggaacttgtaacatcgattgttgcggcaagaaagaatgaagtggatatggcactcggaaatgtgatcggttctaatattttcaatatcctgttggtacttggagttgcagctgccatcagtccagtgaaatttcttaccgataatatcattgatacggttgtactgattgcgatgagtctggttgttctggtgtttgcatggacttcaaaaatgatcgaccgaagagaaggcgctacgatgcttggaatgtatgcagtgtatatggcatatatttgcatacgataaaataaaagaatcataaggaaaaatggctgtggattgaacctgccccaaaagttagacctaaattctaacgattggaaggcggttcaattcacagctatttttattgggtcagtgtacattctattttatacttctatagaaaaaacattgacatgtctaacaaaaagaggtataaaaaacgagagaattttgcgacaaggggaaaggcataagatgggaaaatacaattttgatgaagtaatcgacagacatggaacggactgcctgaaatatgattttggaatgaaacgaaagggaagagatgatctgcttccgctctgggtggcagacatggatttccgtctgccggatgagattttggatgaatttcacaagaggatcgatcatggaatctttggttataccgatccactggatgaatattttgcagcgatgaaccactggttctcaacccgctatggttatacaatcgagccggactgggtaacacttggagccggaatcgtctatgcactcggaacaagcgtaagagcatttaccgaagagggagatgccatgatggtgatgcagccggtatactatccgttcagcgaagtcatcaagaatgacggaagaagactggtgaactgccagcttcgctatgagaataaccattattccatcgactttgaaaagatggagagaatgatcctggaagagggcgtaaaagcactgatcttctgtaatccacataatccggtcggaagagtctggacaagagaagaactggagagagttgcagagatttgcctgaaatacaacgtgacctggatggtggacgagatgcactgtgatttcattttcccgggacataccttcacaagctgtatgaatctggacgaaaaataccgtcagattcttgcactctacagctcaccgggaaagacattcaacgtggcaggacttcagccggcaaatatcatcattccaaacgaagagttgcgaaaaaaatatcagtgggcaaatacacaggcagcttacagccagggaagtctgatgggacagcttgcagtcaaggtatgttacaccaaaggtgctgagtgggtagatgaactggtgcagtatatttatgaaaatgtaaaatatatgagcaagttcgtgaaagagaatttcccgaaagcgaagatggtagagccggaaggaacctatctggtatgggttgatttttccggatatggacttagcaatgaagagctggagcacctgatgctggaggaggcaaaattgtggctggattccggaatcatcttcggaccggagaccgctcagttcgagagattcaatgttgcctgcccgcgtgtgactctggaacaggcactgacacagcttaaagatgcactggataagcatctggcagcaaaataatataaaaagaggattgagagggaaaaaagatggacaaacaaaagaaaaatatgggggcagtggcatttcttccactgatcgtatttctggtatgttatgtagggtgcgggattacatttaccctgcttggagcagacgaaccgttcggaaagttcccgcgtcacgtcgcgcttcttgcagggtgtgcggtagcacttctccttaaccgtggcattggtgtacaggataagctgaatattatgacaacgagcatgggaaattcaggagttatgatgatcgttctgatctacctgatggctggtggattccagggagcagcagcggcaatgggcggaaaagattcggttgtgaatctctgtctgcattttattccggtgaaacttttggttccgggtgtatttttgatgtgctgttttatttctacatcaatcgggacatccatgggaacgattgcagcgatggctccaattgctattaatgtagcacagggtgcacacctgaatgtggcagtcgtcggtgcagcagttatcggaggctcatattttggtgataacctttccatgatttcagatacaaccatttctgcagcagaaggatgtggttctgagatgaaagacaaatttaaaatgaactttttcattgctcttccggcggcaattgtggcaatgatcctgtactcgatttttggcggagtcggaagcggagcaatcgaagcaggaagctatagtatcatcgaagtccttccttattttattgttctaattgcggcacttatgggagttaatgttgcggtagtcctttttgtcggaatacttgcatccggtatcattggactttgtgtcggaagctgtggattttttgaatggatccaggcaattggaagtggtatgagtgatatgttcagcatcagtatcgttgccattcttgtatccggtatcatcggtcttgtacgtgaatatggcggtgttgaatggctggtgggcgcgatcagcagcaagatcaagagcagacgtggtgcggaatatggaatcggactgatgtcaggtatcctttccgcagctatggtaaataatacgatcgcaatcattgttacctgtccgattgcaaaagaaatcggggaaaaatataagatcgcaccgaagagacttgccagtctggtggatatctttgcctgcgcatttattgcactgatgccacatgatggtggtatgctgatgattacggcacttgctgatgtatcaccgcttaatgtactgaaatattcgttctatatgtttggactgatcattgcgacctgcgttacgatacagttcggattgatggacaagaaaaattagacagaaagaaaaataaaatatgaaagatctaacaaaaggaaaaccgtccacgctgattctggcttttgcgctgccgatctttttcgcaaatcttctgcagcttacatacagtcttgtggataccagaattgtcggaactttcctgggagaggacgcgctggcggctgtcggcgcgaccacaaccttaagtaatctgatcattggattcttgcagggactttcggggggattcgcgattattattgcacagaaattcggtgcaaaggattataaaaatgtgaagaaatcattcgcaatgtcgctgaccatgggtacaggaattgcaatattttttacggtgttcggattgttatttttacagccgatcttaaatatactgaatgttccgtcagatctgatggcaacggcaaaaagctatattttcgtgatcattgcagggcttgtggcgacatttctttatgatgcatgtgcggctgcactccggtcactcggagataccgtgacgcctcttgtgatcctggcaatctcagttgcattgaatattgttggggatctgctttttgtcgtagtgctgaaaagcggagtgcggggagctgcgatcgcaacggtactggcacaggcaatcgcgtttgttgtgtgctggatttatatggtaaagagatatgaactgttaagacttagccgggaagatttcaaagatccgaatccggttatggtgaaaaatatgttgggtgcgggaatgtccatgggattcatgagttctctgatcaatatcggttccctgacgcttcagacagcgatcaataaacttggaaatgattatatcgtagcacagacagcggcccggaagctgactgaaatgttcatgatcatgtttacagtatttggaaatacgatggcgacctactgtggacagaaccttggagcaggaaagatcgaccggatcaaaaaagggatctggcttgcgattttctatacttgtatctggtgtacacttgtgatcgtggcaagctacacgattggagataaactggtctatctggtaacaggtacacataatgaaaatgtgatcttaaatgcgaccagatatctgaaatttgatacattgttttattatgtaacagcagtaatctgcattgtgcgaaatgccatgcagggactggatgaccatattacaccgatcgtatcaagtacacttgagatgcttggaaaaattgtaatcgcatttacactggttccacatcttggatacacgggggttatcattgcggagccgattgtgtggtttgttatggtgattccgctgatcgtgcagattttccggatgccggtgctgaagcagacaagcctttcttgacactattcatacgcctgtgctagaataggcttgtttagaaaaataaatacagatgcgtaaggtgtcaatcagacggaatgtctggattggtgaaaagggaaacaggtgcaagtcctgtatgaactcgtcaccgtaatttgcaagcttaggctgtcataccactgggagaccgggaaggaaagccacaagcgtctgagcaatcagtcgggagacctgcctttcgcagtacaggaacggaaagttcatgccacgagtaactggcagtacgaaagatagaaacttcagactgattttgcatagggcaaaatgtcagtttcttttttgtacgccctcgttaaatttagatacgggggatttttttgcttacaaaaaatatgctgtaaagtgtaatgaatatcattccgattcctgaaagtatgacaaaaaagtcagggaggatcaagatgaagaaacgagtattagtagcattactggcaacagcacttacggtgtctatgatgactggatgtggaaacaagaagacagaggacacttcttctacaaagacagaagaaacatccgaagacagcgatcaggaggcagcagacaaagtggcaaagctgatcgatgacatttatgtgcaggaaagaacagacaagacagatgaacagtgtaaggctgcaaaagaagcctgggataagcttactgatgcacagaaagaactggtagaaggcgagaacgctgatccggattattttggaagggatacaggcgatgcatcgaaagatgatccgctgaacgaagataacatcggagaaaatgaaattctggttgtaagctttggtacatcttttaatgacagccgtgcagaggatatcggtggtgtggaaaaagcacttcaggcagcatatccggactggtctgtaagaagagcatttacagcacagatcatcatcaaccatgtacaggcccgtgatgatgagaagatcgacaatatggatcaggcactggaaagagcagtcgacaacggggttaagaacctggttgtacagccgacacatctgatgcatggtgccgagtatgatgaactgacagaagcagttgagaactacaaagataaatttgaatctgtaaaaattgcagaaccacttctcggtgaagtcggagcggatgaaacagcgatcaatgaggataaagcagctgttgcagaagcaattacagcagaagctgtaaagacagctggatttgacagcctggatgcggcaaaagaagagggaaccgcatttgtatttatgggacatggaacttctcatacagcaaagatcagctattcacagatgcagacacagatggaacagcttggttatgagaatgtatttatcggaaccgtagaaggcgaaccggaagataccgcttgtgaagcagtaattgaaaagctcaaaaatgcaggatacaagaaagtaatccttcgtccactgatggttgtagcaggagatcatgcaaacaacgatatggcaggcgatgatgacgattcttggaagagccagtttgaagcatccggagtatttgacagtattgatacacagattgcaggtcttggtgagatcgatgcgatccagcagctttatgtggcacatacacaggctgcaattgatgcagaataaataaaaaaagagggatttataagatgaaaaagaaactgttagtattggtattatctgctgtaatggcagtgggaatgatgagcggatgtggtgcaaaatcagacacatcagatacgaaagcaaagacagcagaaagctcttctgctaaagaagaggaaacagaggaacagacagagtgtgagcttgaagacggaacctacacagcagagttcaagactgacagcggaatgtttcatgtaaatgaagcgaatgacggaaaaggaacactcacagtaaaagacgggaaaatgacgatccatgtcagcctggtttctaagaagatcgtcaacctgtttgaaggaacatccgaagatgcacagaaagatggtgcagaacttctggaacctacaacagatacggtaacctatagcgacggtgcaacagaagaagtttatggatttgatattccggttcctgaactggataaagaatttgatgtggctctgctcggaaaaaaaggagtctggtatgatcataaggtaagtgtgaccaatccggtgaaagtcgaagaataattgaagataagtgaaaggactgtttccctgagaaatgggaaatggtcctttttttgcttgggcatgaactggataacactatacttttatatgtcagatagtgtatactaggcagtggaagatcatacaaaagagagaatgttttgtatataaaaactaaaatgtggagaggaagttaaaatacgatgtactacgtaccagatggcacaaaagagtgtggattttatgaatgtaaaaaatgtggaaaccgtttcttatccttacagacaatgaaccggatcccatgtccggaatgtgaggcagagatcgactatgagatcggaccagacgaatccatggaagatgctctggacacggcagaattactggaaaagatcatcggtgaagaagaagtagagaaaatggatggacttctgagtcttgcaattaccggtggagactgtaactggatttaattttcggttaaaagtgttgaatgggtggttaggaaaaacaaacgaagtgtgttataatagaaatatgagtaaaagagggagaaaatagatggatattcatgatttgaaaatatttctgatgatcgcacaggcgtgcagtgtttccggaaacacgtacaggaatggctgcaaaagatacgctcaggagagattacacgataagaaaaaagttgataagtagtaacgaaaagttgcgggtaagtcacaaattatacagaatgcatgaaaaagcggagtatagtttgtgcctttttgtctacaattccatggaaatagatgatgactataataatggaatatttatagaaaaattaaatttgaataaaatgtataaaagaatataatggtaatacatggatgctggcaaaatatacaaataatcgtgctggcacaaatatattttttacaggaggatttgaaaatgaatattggggtaacagaaatcagtccaagagaggtgcagagaaaggcagagaaatgttttaaagatggatattactgctgtgaagctctggtcagcacgatccgcgatgaattcaaactggatgtgccgaaagaggttgtagctatggcatccggaatggcagtaggagcaggaaaatcaggatgtgtctgcggtgcatttaacggaggaattcttgcacttggaatgttcttcggccgtaccgaacaggatggaccgaccaacccgaagagtatcaaatgtatggagcttacgcacgagcttcatgactggttcaagaaggcaaatggtaaaaatgcaatctgctgcagagttcttacaaaggaattcaatatgggacagggtgaacacaaagaacagtgtatctattttacaggactttgtgcatggaaggtagcgcagatcgtctgtcgtgagcttggtatcaagaatctggatgaaattgatgaaccgtgcgaaagaagaaaaattgcagatatctaaataaagtggtaacgacagccgcttgatgagagaaagggaaagaaacaatgaaagacgtaattaagaaagtaccgattccgctttgcggagtcatgcttggcgcggcagcacttggaaatctacttcagagctattcagaaggaatccgttatgtatgcggtatattcgcagcatttcttctgatactggtgcttttgaagctgatcatgttcccaggagcagtgaaagaagatatgggaaatccgatcatggcaagcgtatcaggaacgtttccgatggcacttatgattctcagcacttatgtaaaaccgtttatcggaaaggcagcttattacatatggcttctggcaatcattcttcacatcattctgatcatatactttacggtgaagtttgttctgaaacttcagatgccaaaagtatttgcaagctattatattgtatatgtaggaattgctgtagcggctgttacagcaccggcttatgagcaacttggaatcggaaccgcagcattctggtttggatttgtaacactgatcgtacttcttgtacttgtaacctatcgttatgtgaagtttaaagaagtgccggatccggcaaaaccgctgatctgtatctacgcagcaccgaccagcctgtgtattgcaggttatgtacagtccgtaacaccgaaatcatacggtttcctgatggcaatgtttgtagttgcaacggttatttatatttttgccctggtaaaagcagtgggatatctgaagatgccattcttcccaagctatgcagccttcacattcccatttgttatcagtgcgatcgcaactaaacaaactatggcatgtgcagcaaatatgggacatccaatgccatttcttcagtatgtagttctggtcgagacaattattgcagcagcacttgttgtttatacttatgttcgttttatgggggctattttcggaggaaagaaataaaagatttgaccggacagataaaaaagggtaaacttaaatttatcaagaatatgtcggatgagggacgtcctagacaccgcaaggggccgaagaagcaaagcgtaaggtaacatcttcctttcgtggaaactgacaggcaaaaaggaaggcgacctgacgaatctttggagagtgtgcaaagaaagcaccacctacgaggctagaaccaactggtaaaaggacagagaaaacagatgaacgatttttttcgtgtatctgtttttttctgccctttttatatgggcactaatatgagatgagactgttagcaggcagtacgtggtggcatacagaagtattatccgaggaagaagggaaagggcattttttgaataaaatttgacagaagaaaaagaaaagctggaggaaaaaaagatgagaatgatgcttgtaggagccggtgctgtcggtgaaagtattttaaaagtaatgcagtggagagaccaaaagggagaatggctgaaatatgtgctggtctgcgactatgatctgaaaagggcagaggaagttgtcggtatgatgaagggggattcccgttttgaagcttctaagattgatgcgacaaatacagagaaaatggcagaactgatccgggagcataagattgattttgtgatggatgcagcaccaccttttgcaagtaatatgatttttgacgctgcatttaaaacgggtgcagattacggaagcatgggaacctggtcggttccgatggaaaatccggcttacggacttggtattgagaacagctatactgaaccgatgacaaaatacaattttgaccgtcatgaagcctggaagaagcaggggaatatggctgtgatctgtatgggaatcgatccgggtgttgtaaatgtatttgcaaaatacgcggcgacagagcttttggatgaaataacagaagttcatgtaaaagacggcggaaatctgtctgttccgggtgcagatccggatgacattatgtttggattcaacgtgtggaccgtgctggatgaggtaatgaacccgaatgttgagtatgataaggagaagggcggatttatcgtagaaaaagcatttgcagggcaggaagtctatgagatgccggaaggagtaggaaaaaataccctggtaaaggtagagcatgaggaagttgtgacgatggcacgctacttaagccagtatggattgaaaaaggcaaccttcaagatcagtcttgatgagaatctgatcacggcacttaaggtgctggataagctgggacttcgcagtatcaagccggtgcaggtaggggatgtgaaggtagttccaagagatgtggttgcagcctgtgcaccgcagccaaaagatatcggagatgagatgaccggaaaaatgctggtcggagtacagtgtatcggaaagaaagacggaaaggaaaaagaatacttcctgtatcagccatttgataatcaggagtctatcgaaagatggggaacccaggctgttaccgcccagacaggatttggagcagcacttgcactggagctgatcggaagaggaatctggaaagaagctggggtctatgcaccggaatattttgatccgaaaccataccttgaattaatgaaagaaagtggttataaatacggaattatagagaaataatctggatgcgctcagagatggtctgagaaaataaacaaaataaagttacgcgcaaaacggtacaaagtcatagaagaactttgtaccgttttgtgtgtgacaggaaatcagatcaacttacactctttggcccatttggtgacaaaggtaagaaacttatcaagtgcaggagagagttcaggtgtatccagataggctacggacagattcctgcggaagtgttcggtaaaggaacggacacagacgttgaatggaatattatgaagcagaagtttgggaagtacagtgatgccaaagccctgttccaccattttaatcgcggtatagtcttcattgatccgaaatcttacgttaggcgtgatatggtttaatcggaataattttccggtttcataatcaaaatcatcggcggagagaacaaaatcctgtccgtcaatatcggcaaaagataccgtcagctgatcggcaagaggatggtccagggaagtaaccagaaccagttcgtcggtgccgacaggcagatttgggaaatcctttgcgacatattgcgaaacaaagatacagtccagttcttttttgcgaagcttttccgtcaggttctgaaatccgtcaacatagagccgaaaggtgatattcgggtattcggcagaaaaatttttcagtactccggggagccagttataggcaatgctctgcaccgttccgatgcggataaaaccactgtccagattgttgatatttgagacgatctgatcgatccgtgtattggcggagcggatatgcataagttcttcaaagatgggttctgttccgggaagtgcttccattccgttttttgaacgcttgaacagcttaagaccaatctctttttcataattgcggatagtctggctgacagctgactgtgtgtagttgtgtttttgagcagcttttgagatgctctgattctcatagacatcaagaatcacatcgtatttagacatgatgaaacctcccgtggtgttgataaacaatgctcttttactatcttacttaatataaggaagataatcaatatctgtgggattttattataaatttttttaaaatcaaacataagaaaaagtgaaaatataagcgcaaatcaaagagttaacaatgtattaagaaaaagtgaagtctgatatcagttttacagacttttcaatgaccggaaactggaatagcatagaacaggggaatgaaattcaaaggagtttaagtgtatcatgaattaaaggagaagaataatgggatacaattactggaacggaacagaagcggcacaccgccgtgttatgatgaaggcggcaggatattcggatgaagatatccgtcagaaaccgcatatcggaataccgaattcttacatggcaggttctcccggaactgcgcatcttcgccaggtgacagaagctgtaaaagagggaatctgggcagcaggaggaatcccggtagaattcggaatcccggctacttgcggaaatgtggcaaatggtgcggatgagatgaagtatgagcaggtaggaagagatatcgtggcaatgtccatcgaatttgtatccagaatacataatttcgatgcgatctgctgtgtggcatcctgtgatctgatcattgccggatgttatctggcagcgtgcagactggatattccggctctggtagtgaccgggggatcaatgcaggccggaaattactgtggtaagacagttgtagaggcagatctggatgcggcaagattctcaggtgcttccgaagctgagttatttgaaatggaagaaagcgtctgcccgtcattcggtgcctgcccgtccatgggaacagccaacacgatgcagatgttaggtgaggtattgaaccttgttatgccgggaacatctacgattcctgcatcagataatgcaagacttcgtgctgcaagaacagcaggaaaatacatggtacagcttgccaggtccggaaagacaccaaaagatctgatcaccaaagatgttctggaaaatgcgatcatgtttgatatggcagttgcaggatcaaccaatgcggtactgcatatcctggcatacgcatatgaacttggtatcaagcttacactggcagattttgaaaagtatgcgaaggaaatttactgcatcaatgcagtgattccaagcggaccgtatacagttgtagattttcattatgccggcggtgtaaagcaggtcatgaagcagcttgccggtaaaatccataccgatgcgccgacgatttacggggatacaacttggggtgaactcctcgattctgtgaaaagcgcgccaaataaagtcattcattcgctggaagatcctgtagcaaaagaaccgggacttaaaatcatgcggggaaatatttctccggcaggagcgatcgtacgtccgacagcagtatatgaagaagtaaaatacatcaaaggtgcggcaaaagtgtatgaatgcgatcaggatgcatatagagccattatggcaggcgagattgttgcgggggacattcttgttatccgttatgaaggctgtaaaggagcaccgggtatgaaagagctgatgcttagtatcgatgcgctgatcggacttggacttgataaaaaggtcgggcttatcacagacgcgcgtttctccggattcaactacggagcaatcgtcggacatgtttctccggaagcttatgacggcggtgtgatcgctttgatcgaaaatggtgatgaaattgagatggacattgcagggggaaccgtcaatcttctcgtatccgatgagatcttagcagaaagaagaaaatcctgggtacgtccgccgcttaagcagcagaagggtgttttaaatatttacgcacagaactgcagaccggcagaagaaggcggtgcaatgcagccatgggcactggatgcagactacggatatcatcacgaataaaagtattggtatggataaggagagaacgggtatgttattgctttcaaaagaggatattaaaagtgtaattacaatgaaagatatgatcgaggcggacaagcaggcatttaagatggttgtcgatggtacggtagatacaccgcttcgtacagtcatcaatggaaaatatgacggcgcatttctgtttatgccggcttatgctccggaattagatgcagcagccatgaaggtgatcaacatttttccacacaatatcgataacaatctgatgacatcaccggcgcagaccatgctgatcgacggaaagacgggatatgtgatcgcgatgctggatggaacttatgtgacacagcttcgtacgggggcctcttccggtgcagcattcgatctgcttggaaaaaaggaatgtaaaaaaggtgcaatgatcggtacagggggacaggcagcagctcagcttgaagcaatgcttgcagccagaaaattggaagaagtaaagatctttgacctgaatgaagaaagatgcaaagcatttgccgaagaaatgcagaagggactggctaaatacggtgcaaaaatcataccggccaaggattcagatgactgtatcgaagatgcagatcttattatcacagtgactccttccgcaaaaccggtatttgacggaacaaaggtaaaagccggtgcaaccatcagctgcgtaggtacttatgagccccataagcatgagctggatccggcagttttaccgagagcatctaagattatctgtgattcaaaagaggcggcgctttcagagacgggggatcttctgattccgattgcagagggaatcattacagaagaggatgtgcttggaagtcttggagatgtgatcaatggaaagatcaaaggacgtgaaaatgacgaagaaattatcgtatatgaaaccgtaggagttgctgcgcaggatctggtggcagcaaaggtgatttatgataaggcagtagaagccggaaaaggacttcgctggggagaataatctaaaaagaggatgtaaatacaaaaaacacggaatatttccgtgttttttgtattttaaagaatagctttgtgataagataaacaagaacaataatttaaagaaaaggaaacaagagaaatgctaactacatggattcaggcagtataccaatttttatggggagatcttttaaggataccacttccgggaggttcctcttttggtgtgtcactgcttattattttactgattcccacaggaatctattttacgatcagaacaagatttttgccggttcgtctttttggagatatggttcgcgcgcttaccgggaaaaagaaggaagatggcagtctgtcgacctttcagacactgatcgtctcaactgcaacgagagttggaatgggaaatctggttggagtagtcgctgccgtttccgcaggcggtgccggtgcggtattctggatgtggatcacagcgatcatcggttcttcaactgcgtttatcgaggcaacacttgcacagctttataaagaaaaagatccgctttacggaggctaccgcggaggtccggcatattatatgcatcattatgtagagagacggacaggaaagacaaagaaacatgtctgtattgcggtgctctttgcaatctcagggcttatctgctgggccgggatcagtcaggtgatcagtaattcggttgcatcttcttttgaaaatgcatttgggattccgccaatttttacgacggtgattctggtagccgttgcggcagtgattgtactgcgaaaaaatgccacagtaaaggtgttggatattctggttccaatcatggcagtctgttattttgtgattacgatagtcattatcttattgaatatccgaagccttccgggtgtatttgagcggattatccaggaagcgtttgggatccgtcaggcagcagccggagggttcggagcagttcttatgaatggtgtaaaaagagggttattttccaacgaagcgggttcgggatcagcaccatgcgcagctgcggctgcagaatgtgatacgcctgtaaaagcaggatttatacaggcattgggtgtatttatagatacaattgtgatctgcaactgtacggcgatgatcatgcttcttgtgccggaaaagatgatagcaggactggaaggaatggagcttttgcagacagcaatgaattatcatctcggtaaatttggcgtgatctttattgcggttacgttgttccttttcagcttttcaacgtttcttggaatcctgttttatgcaagaggaaatgtggcatatcttttaggggataagtggtgctggcagacagcatataaaatcctcgcacttgtgatgctctttatcggaggaattgcggcttatcatattgtatgggatcttggcgatgtgggaatcggacttatgacgatttttaatattgtgactttgtatcctatgggtggagaggcactggaggaattgaggaagtacgaaaaaaataaacagtaggagaaactggagaatgtcaaaagatgaatatttaattacagatgcgcctcttaaagcattaactgtttttgcaatgcctatgattttaggcagcttttttcaacaagtatataatatggctgattctattatcgtaggtcagtttgttggttcgtctgcactggcggcagtcggtgcctgcgccgcacttacgaatgtcttcatttgtatagcattgggtgccggtgtaggtgcaggagtgctcgtgagccgttattttggagccagagattatagtaaaatgaaaacaatcgtgtcaacatcattgatcagcttcctgattctaagcgtacttctgggtatatttggcttttgtttttcccattcgatgatgagtttattacagacacctgctgatatactggatgaagcagtactgtaccttcgtgtttattttgtgggatttccgtttctgtttatgtataacatcctttcaacgatgtttacctcgatcggtgaatcaaagattccattgggactgttgatattttcttctattttgaatatttttatggatctctggatggtggccggacttggtttgggggtatttggtgcagctcttgcaaccctcattgcgcaggggatttcggcagtgttttcacttttgattttctttagccggatgcgtcgatataaaagtcattttgactggtttgatgggaaggaattgcattccatgcttcggatcgctgtgccatctgttcttcagcagtctacagtgtcaattggcatgatgatcgtacaggcagttgtaaatccattcggtacacaggcacttgctggttattcggcaacgatgcgggtagagaacgttttttcactgatctttgtatccattggaaatgcagtttcaccgtatgtttcccagaattttggcgcaaagaaaatggaacgtatcaaaaaaggatatcatgcggcacttgtgttggatttatgttttgcagttcttgcttttatagtcattgaaacgctgcatacccagatttcctcgttattcctggggaaagacggaactgccctggcatatcaggtgtccggggattatatgagatggcttggttactttttcatttttatgggtatcaagatggcaacagatggagtcctccgtggacttggtgttatgcgcccgtttctcgttgccaatatggtaaaccttgcaatccgcctgacagttgctttgatttttgcacctcgttttggtatcgaatttgtctggcttgccgtaccggctggctggtttgccaattttgtgatttcctatgtggcacttagaaaatcgtggccaactgataaagcagcttcagtttgctaactgtctgtttattccggaaatagaattacccgcaccaacggtgcgggtaatagcataagtcagcaagaatataaaatcagaaatataatgccgaaaatccttatggaagcggatgacctgcagccaggtacagctcataccattcttcgcgagtcagtgttatctcacatgctgcgataatttctttcaggcggctttcgcttgcagttccggtaatgatttgcatatttgccgggtggcgtaaaatccacgcagccgcaatggtagtgtcgctgacattatatttttcagccagtacatgaagcttttgattcagttccgggtattcgtcacttccgagaaagcatcctttccatgccggcatctgaaatggtgaccaggcctggagggtgatatcgtggaggcggcagtagtcgagcagacttccgtcgtggtcaattgaaccgggggtttccatattgacttccatgccatttgcaacaagattggaaaccggaatgctgaattgaacctggttgacaacgagcggttggcagacatacttctgtagcagtgcaatctgcatcggtttgtggtttgaaacaccaaaatggcgaacctttccgctctcaaacagaacatcaaatgcggcagcaacctcttccggttctacgagtgcatccggacggtgaagcagcagaagatcgagataatctgtctgaagccgttttaaaataccatcgacggatttcaaaatgtgctcttttgagagatcataacaaccttgccggatgccgcattttgactgcaggtaaatatcttcccgtttcagggatggatcgccggcaaaggcttcgccgaacacagtctcgctcataccgccgccgtagatatccgcatgatcgaagaaatatgcgccctgtttcaatgcagagtgaatgaaatggttcatttcctccttcgatttttcagaaagtcgcatgcatccgactgcaatggaaggaattttttgcagatgattgcccaaaatagtttctctcatgataaaaatctcctttgtaatgatttgatattcgcggaatttttccgtaaagcaagtatggaagaagtccggaagtaaagaaataataattgttatacttttgaccatagtatcatcatatcatagaagcgcactcgagagtcaatgaaaatttcttgagatagctattaaatttgagtaagagatagaagagcagatattatatcttgaaaaaagtacattccattggttccgttgaagtcaatagattcctctttactttcccgacacaactgctataatatatcagacagcaagtaaaggcaaaacagagaggaattctataatggacattatacaaaaatttggtaacgcagtgagcagtatgtctctggaggatcccgggaaggcgcgcaggcttcttcttacaggataccgacttcaggagaaacgactgctctttttttcagataaaaagctgcccaaatcgggacagtatgtagcaagaattgttatgaaaaatatcatccaggcactttcaaagcctgaaaattcagcgatggtcagcatctttgttccgggagagcttttgacggcggcagggctgactccgtattcggtagaagcaatgtcctgctttatcgcgggaacaagatgtgagcagacatttttgagaaaaacagaagaagagggatttccggaaacgatgtgctcctatcacagagttttccttggagcggcactatccggacttgtgccaaagccaaaatgtatgatctacacaaatctggcatgtgacagcaatatgatgaccttcccgtatctgaagcagaaaaatatgcttccgggattttttatagatgtaccgtatgacaagaacgaagattctgtaaaatatgtggcagatcagctccgggagttgaaagcatttttagaagatgttactggaaagaaaatttccgaagaggcagtacggcaggcggtcaataacagcaaccaggcagccgcatattatcatgaacagctggcactgcgcaaagaacatgatccggtcacgagcctgaccaatgagctgtacgcgattttcatgtgccacctcatggcgggttcgcaggaggcagtcaagtacacgaaattgcttctggaagatgtgaaaaaggcaccgaagagcgaaggtctgcatattctctggatgcatatgatgccatttttgcaggaaccggtaaaggatattttcaattacagtgaccagattcatatcagtgcctgtgactttgtggcagacggatttcagaagacacattatgaagatccgtatgagtccatggcagaaaagatggtgaactgcatttacaatggaagcgtcaggcagagaatccagaaggcaaaagagcttgcggcgcagacaaatgtggatggaggaatcctttttacacattggggatgcaaaggtacgatcggagcttccagtctgatcaaaggatcgcttgaggaagcaggaatcccgaccatgatccttgatggagatggatgtaatccggcaaacagcagtgatggacagatttctacaagacttcaggcttatatggagatgctgaaggtaaataaagcagaaaaatatgccgcaaatcacggaaagggggctgggtcagatgatacattatgtctgtaaatatacgccggtagagttattgaatgcatttggagaagagtgtgccgtactggaggaaatgccggagaactttgaaatgtcggatcagatcgcacacgcaaatctgtgcggctttgggaaatctgtgattcaggcagttctggaaggaaaggtcaagcagcttgtacttgtgaactgctgtgattctgcccggagagtttatgatattgtagagagcaccggaaaatgcaaatttttatatatgctggatcttccgcatgaagataatgaatgtgagaaggtaaagtatgcacaggcaatcatgcgtctgaaaaaagcatacgaaaaattttccggaaaaacatttgataaggaagcatttttaaattcatttacagaaaatgagacagaaatgaagccatacattggtctgatgggtgtgcgtgtaacgggtattcttgaaaaaatgatccgggataatattcagatggacgtggacaatcttacctgcaccggcggaagacagcttgcagttgttccggagcagatgagacagatggatgaagaaaaaatgtttctggcttatgcggatgccctgctttgccagatcccatgtttccgaatgaataacaacactcggagaaatcagctgtatctggatccaaacctgaagggaattatttatcatacgatcaaattctgtgattattatggatttgaatatgcgagcattaaaaagaatatcaaagtaccgcttctgaaaatcgagacggattttacaagtcagagcgctggacagttactgacgagaatccaggcatttgcagaaacgattgaaggatcggaagacatggatccgggaaaaggaatcagtgaggaggcaagaaaaaagatggagtcaggaatatattatgtagcagggatcgacagtggctctacaagtacagacgttgtgattttggatcaggacggaaaaattaaatctacgatgatcattccgacaggcggcggagcgatgatgagtgcggagaaaagtctggatcttgctgtagagaaggcaggaattaaggaagaagaaatcgttagaattgtcacgacgggatatggacgtgcttatattgaaagcggggatgacagtattacagagatcacctgtcatgccaaaggtgcgcattacctgaacccgaatgtgcggacggtgatcgatatcggcggacaggatatcaaggcaatcagcatcgatgaaaatggcgcagtaaagaatttcctgatgaatgacaaatgtgcggcaggaaccggaaggtttctggaaatgatggcacggactttgggactttctcttgaagagatgagtacaaaaggattggaatggaaggaaaatattgtgatttccagtatgtgtacggtgttcgctgagtcagaggtggtatcacttgtggctcagaataaagatgtggcagatatcatccatggtctgaatgtgtcggttgcttcgaaagtaggagcactggcggcacgtcttgggaaaaagaatccgggagaatatatgatgacaggcggagtggcaaagaatcctggaatcatcaaagcactggaagaaaagctggatgcgaaattgtatatttgcgacgaggcacagctttgtggtgcacttggagctgcattgtttgcatatgagaagtgcagtgtgtagaggctgtgtttgtaatcaccggacattattttatattgcataaaaaagagaaaccttaccaattttcagacgtaaaaattgaaaaccggtaaggttttttacgcatatcgccatgcaatatgcaattatcttttatttcattgcatctttaattgcgccaagcagctcttcataggtttcatatgccgggatctgcggataatccgctttgatcttgtctgttgaacggaataaaaatcctgccttacttgcctggatcatacccagatcgttgtaagaatccccacttgcaatcgtttcaaatccgatggattgcagtgcctttacggttgttagtttggaattttccacacgcatcttgaagtctgtgatctcgccgttttctgcaatttccagactgttgcagaaaagcgtcggatgaccaagcttttccatgagcggcattgcaaattcggtgaaggtatcactaagaaggattacctgggtgaaggaacgtagctcatccaggaagtcttttgcgcccggaagcggatcaatcttggaaattgttttctgaatttctttgatcccgagaccatgcgcttttaaagtatccagtctccagcgcatcagtttgttataatcaggttcatctcttgtggttcttttcagttccggaattccacttgcttctgcaaatgcaacccagatttccggtacaagtactccttcgacatccagacaagtaatatacatatgttaaccctcctgtactttctgttttttgctttctatcataccatatatctgtttattttgcattcttttttgtaattgattaaaaattgtggaagagaaacctgtataaactacatgatggtatggaaaaccatgtaaagaagtcagtcgggaaaattgcgggttccattttggaatgtgtgcgaaccggaaagatattgacgataaattttttcagggactataatataagtatctgtgacaaaagagggatgtttcggaatgaatcattgaaaaaagaaaatctgccgaaacatattttgctcaaattgcataaaggagaaaaaggatgaataactttatttttgaaaataaaacgaaagtatatttcgggaaaggatgtgtcggcgagtatttgccgaaaatcgctgcggtgcatggggataaggttctgcttgcctatggcggcggctcgatcaagaaaaatggagtttatgaggaagtcatagcggcacttgaaaaagccgggaaaacgatcattgaatttccggggatcatggaaaatccgacttataagaaggtgcttgaaggcacaaagctggtaaaggaaaaacaggtggactggatccttgcagtcggcggtggttcggttatggactgtagcaaggcaatttccatggcagcggtcagcgagaaagatgtgtgggatgagtactgggcgaagaagggtgttgtggattttgaaccgatgccacttggcgtgatcgtaacagcgtccggaacaggcagcgagtgcaacgggggagcagttattaccaatgaagaggtcatgatcaagacagaccgggattatccgaaatgcaatccggaatttgcattaatggatccgacttacacttatactgttccgacaaaacagatggtggcaggaagctttgatatcctgtctcacgttatggagacttatttcagtgagccggatgaggataacgtatcagatgatatttcggaagctctgatgcgcggcgtgataacaagtcttcgtgcggcattggtaaatccggaggattatacagcaagaagtaatctgatgtggctgtctaccatggcggagaaccggatcatcaagctcggcaaaaaatgtgattttgaatgccatcagatggagcatcagatcagtgcttataccaactgcagtcatggatgtggacttgctgtgctgcatccggtttattatcggcatatctgtcaggcaggcgcaaagaaatttacccgatttgcggaaaatgtatggaaaattccgagaaatggacgtaccgatgaagagatggctgaagctggcgtagaggcattggctaattttatcagagagatcggacttccgacaacacttcgggaagtaggcgtggagaaaaaagaggatctgaaagaaattgcggattcttgttatctggtggatgaaagttataagaagatgacacatgaggagattctggaaatatttctggagtgcttctaaggacaatagctaaaaggtgatattgattcactggggcttcagaagccgtgctatgtggatgaacagacgcactaccgctattatgacatcaagcagaatgcctgtctggacatgattcagtatatgaaagagcttggaatggaactgaaagagattaaaggagctgtcggtaaataacgttttttagagctgacagcaccaaacaaaaatatcctgacagttacagagctttctggctctgcaacttggtcaggatatttttattttgataaatactttctgtttttggccgcaaaaaatccttgtttggattttttcagccgcatttttttctaggcagtttttccttcaaattttctcagtttttcgtataaaaaacgatgatatttatttatatttcttccaatagcatacagcatgaattctttatataccttatctgccgaacggtaattaaaacgccggaagttctcattttccttgatatctccaaaatgtccttccgtctgaatggaacgtgtctggcgtttcaggatcccgcgttcactctggatattggcatgcgatctttctttcagttcctcccattgttcattgatcttcatgactttgttcttttcggcatctttttccgcatcatacttatacagacagcgcgctttatgttcacatccgctgcagtctgcacaaccatatacctcaaaggtctgtgtatatccatcctgctctttgctctctgtactgagatgccgcagttcacgtccgtcatggcagatatagaactgttcatcttcaaagatccctgtccgcatgttgtaatatttactgatatcttctgaataagcgtgtgtttttcgcttttcatgatcctgcagttttatataactggatatttcattccgttttaaataaagcagatttttttcactacagtacccgctgtccgcagttacttcttccagaatactcccgaaagcattcttatgtttttcaaggaccgggatcagggtattataatcggtgcggtcgctgcttacatatccatgtacgataaaataattctctaccgcgatctgaacattatatgctggctttaactgtccgttcagcatgtgatcttctttcatacgcataaaagtcgcttccagatctgttttggaataactgtttctgtcttttcccatgatctcaaagcattctttatattccatcagtcgttttccgcattgttccagttcctcatgcagctgttgaagtgcaggttttctttttccttttccgtaaacgaattcgatttcctcgttgtctgcgatcatcgtgagattgttctggagtttccgtatttcaagcggtgaacagttatcgatctctataatacggttatttgaaagctttttatgttttacaagctttcgttttctgttcttttcgatcacttcccggactttatccatcccttcgatcacaaacatctgtgcatttcccagctcgtactttgttccataatcattctcctgcaaaaaagaattatatttttcaaaaagctggtcgatagagtccagaagtcctgccagatggtaattgatgcttccgcgccatacaaaagtataacggttcgcatttgcctctatctttgtaccgtcaataaaaagttcttttaatgtgaccagcccttctttctgcagccgccgcataaactggtaattcaggtcatccaggacagcagatgtcagcttcctgtttttaaagtcataaaaagcatcacgtttcggtttttgtccgcgcgtcagccagataaaagcaaggtctctttcacacagatcaacaatacggtcaacagaacgtattccacgcatatttgcataggtaactacagcatacatcataattgggttgtacccggttcttcccttatctgaacaattggctaacaagccagaaaaatctaattcctccatcacttttttcagggtatagactggatcgtcgtcaggtaaactcaattcgaagaaactaaagttaattttctgttgcccaaactcaaaaaaatcgttataataattagttgttagcatagttacattataacatgtaacggagagaaagatggttgtcgttagccatctttttttcttttttcagataaattcagggagggtatgactcgttgtgagtcataccctccctgctttggaactatctatttcccgacagccccttgtctcaggtagtaaaatttctatactggatggatatcttggttaaggtgatctgaagtgttttgaggatttgtttcctccgagtgttcattcaccggaagatattcatacttcggaatgaaatcccgtttatcgtacagtttataatactgaatgaaaatacggtccataacttttggaatctgactttcatctgattcaaataaaatgatcaggtactgcagggcactataccgtgtacacacgtcaatcctacggatcttgtgacggatcgcttcctccatgtattccagtgcctgttcaatattttcaatatacatcatagaatccggagcggtttccattgtgaccatgaccaggaaacaatggtatttatgtcgttctccaagttggttgatgtactcataaatcttagaaaattcacggtaattaagattaagtgctccggaatagtttccgctgttgcgaagtacttttgccacaagggaaagatcttttgctacgctggaaaccgggaatacggtattgcccatctgttgatagaaaaagaagttgtgttttccgttttgcttgacataatagagtgctttatctgctttggaagaacattcgtcaaaggaatctcccttggtacacatgcaaagtccggcagaaatggatgcaacacggatctcaaaatcttttttcttctcagaatcaaagcgggaaaacagagtttccataagctcggatatttcatttttaccggcatccggtacaaaaagaaggaattcatcgccaccaaacctgcagccaaccgaatttccgatatgctcggagaggagagctccaagtgctttcagtgcacggtcgccggctttatgaccgtagatatcatttatctttttcagattatccatatccataaagatcagacagccattgtgttcctgcatcagctgtgcgatcattttctgaccggtatttcgcatagggagtccggtaagaagatcaaaattttctgattcctcctggctcttcatcgtattcataacattggaaatgaagttgctgatttcaaattccatgccaggaagagctggctcgtcatcaatttccagataagtatctgtgatcgtcagacgattctcatccatcagtctgagaaaaatatctgcgatttccggatcgaactgagttcctctgtttttgcgtatttcttcataaattgtttcttttggaagagaattacggtaaatacggcgggaattcattgcgtcatagctgtcagcaacagcaacgattcgcgcatgaatcggaatttcttcaccttttagaccgtccggataaccatggccatcataacgctcatgatgagatcgggcaacttcggttacatgattgatgatcgaaacatttttcaaaatctcagcaccaataaccgtatgttccttaataacagcgtactcttcgtttgtcagtttggatggcttgtttaaaataatatcagggatgccgacttttccgatatcatgcagatgagctgcatgtcggagattgatgatttcagagcgattccaacccatttcctgcgcaatcagtgcagagtattccgcaacacgatgggagtgccctctggtgtattcgtccttggcctcgatggttgtagagagagtctgcatcatctgtaaggaaattttttccatctgccgtttacgtttcaaaagctcctctttttgacgatgcatttcaatggtatgcacattctttattgtacggataatgttaatgaaaagaaggatcaacatgctgacaccaataaaaagaccggaaatcaaaactacaaaatatgtagaaatggattcgatggcgatggcaagcattgcaatgatcaggccaatcagcaccaatttgtttttccggtattctttctttcgcatatccagacagaaagtcaggaaaaccagaaagaaggtgactgcaagaatcacgtgggcgcccggcagagtttcaataaaatcagcagtgccagtcagatgaagaaccagacagatcaaaaagttaccaaatgccgcacagccgaggtaaaagtaaggctttttataacgcccctgctgaatgagatctgcataaaaaagtaccgggatcggaacgagcatgatcatcacaaagcataaagtccccagtgcagatggattcggaactataagctgtctgagcttggattcgccgagcatccatgtagctcccatggtcatgcaccatccaagatattccatatcgaattttctgtcatagacaattccgagtgcgatactgaaaaggatggtaatgataccggcgaacaagataaagaaagcaataatagtctcaagcccgtaagattcaaaaatatattcccagatatcactcttgtctccggaatagatctcattgactacaccggaatagttagaggtattggtagtcagctcaatacggagttcttttcctgcatctgctgctgaagtaggacagaaaacataacagctggcagaatttttcccagtcagtcgatggtctttggttgagtattcagtgcgaagcactccgtcaatatagaaacggatatcctgcagagaggaacgtatagcaagtgaactttgtgtataattttcaggaagtgttgtggtaatgaccatagtctcttttgcaggaacattgtaatgtccggggacggcaatctgttctttgcttccatcggagtgaatccaggtaaaagtaccacgatatgtgatgtcgctggattggattttggcattgtgattgttaattcctgtgaattgtattaccagaaaccagataagtatcaggaacatcagaagatagtaaaatccgatctggattttgcttattttatagttttcttttgtcaaaacagagactccttatctacaattttggtctatttgaagatattatacgatgtgagtgtcaaaagtgaattttgccacttactgatgtaaccggattgctccattgctacgcaattcctgcaatccttaaacatcattatactatttgcggacaatatttgcaattaaagagaaggaggaatggtggaaaaagacaggtcatgttgctggtcacagtacctgtgaccagcaacgcatctcgccattttaaatcgcctttggcgatgggcgagatgccattcaagataaaacgtgcatccttcgtgccaatcagcgtagtgattgacacgggagtgaacagtaaccaggtcatggcagttgagaaatactagaagatagattataatttttgtaaaatattttgtgtatgaaagggaacgtaaaatggtaaaattaagcacactttgttatattgaacaggatggaaaatatctgatgcttcaccggactgtcaaagaaaatgatatcaataaagacaagtggatcggagtaggcggtcattttgaaaaaggggaaagtccggaggaatgtcttcttcgtgaggtatgggaagagacaggatacacgctgacatcctggagatatcgtgggattgtaacctttgtatatggcgaagatgtagtagaatatatgtcgctttatacggcagatggttttacaggaacgccgattgcgtgtgatgaaggagaactggaatgggtagaaaagtctaagatcggagaactggaattgtgggaaggggatcggatcttttttgaactcctcgaaaatgagcagccgtttttctcattaaagcttgtatataacacagatgatgttctggaatatgcagcgttagatggaaaagagatgaaagatttcagaagaagagagtgttaaagtggaatgtcgaatagtgtgaaaaagttacgaaagtaatgttttggcatggaatgttgagtctgctcatttggatagtgtatgatgataaagattctcattaaatgaagggggaaaagagaatgtacagtgagttgacaaagatggaagggaaaaggattgtaatccgcacattcggttattttgatatttttgtggatggggaaacgattcctttttcatgtaagaaagccaaagaactgttggcacttctggttgacagaagaggaggatttgtgacgacgggggatgcgatcagttatttatgggaggatgaatgtacagaaaaaagaataaaagataaattccgcaaagtggtaaaagaacttcggagaacgttaaatgcatacggaatcgaaagagtcctgcaccgggtaaatcaggagagccgtatccgcacagagcatgtggagtgtgatctgtatgactacctggaggatgaagaaaaacataaaaagctgttcaaaggagtgtatatgacgaattacagctgggcggaaaacactttgggaacgttgttgaatcaaaaagaataatgggaaatatagcaaaaatcgggagactgttatcagacagcctcccgatttttttgaagagattttattggactacacattctttgtacagttttttgattgtgaatgtctgctgtaaaaggaataaaaaatgaatggttcaaaagattttgtaaaagaaacgaaaaaaggatgaaaaagaaacggtttttggacggaaaagaaacggaaaacggttgtatggatgtgtaaaatgaggaaaggatccgaaaataaaaagaaagagaggaaaaagaatgagacaattgagacggctgttatccgttttggtaatggcagtaacgatcgtggggatgtcgatgacggcatttgcacaggaaagtgtatcgggggcaggaggtaatggcagtattacgattgagaatgcatcaaaagggattgtatattctatctataaagtatttgatgcaaaagtgaatgcggaagggacttcagtagcgtatagtacaaaaaattttgtagataatccgtattttgagaaagattcggtaggaaacatatcggcgaaaaaagaagcatataaaacagattctaacgaacagctttcagaaggtgcaattgaatggattaaggagaatggaacaaagatatgcagtaaaacttccgatggctctatattaaaaatcaccggtcttccatacggctactattatgtcaccagcactttaaaagatggcggtatgattatggtaacgagtgttgcaaaagacgcgcagatcgtggacaaaaacagtaaggagccgcagtggactccggggaatgacgggaatgccggagggaaaagtattgtacttgacgatggtaaacaggtaaaggaaaataatgtcagtatcggtgaaacggttcatttccgtttacagatcaacacctcgaattatgttgcagacaagcagatcaaggaattcattattgaagatactcttccgaccggatttgatgtagcaaagatctcatctgtgatgattgaagaagaaccgctggaacagtttgaaaatacaactttcccggttacgatcccttgggcagcggatgaaggagaaaatggctggaaaaatctttatgataccggggcaagaattaccattgattatacggctgtgttaaacgataaagcagtgatcgacggtgaaggaaataagaacagtgccagattttcatggaattatacgacagaggaaccgggaaaaagctcgatagaggactctacaacaacagatacctatgcggttgtgattcagaaggtcaatgaaaaaggagaggcacttaccggagtggaatttgaagtgccgttcccggttcaggcagaagaagaaagcggtgtgtatactgtaaaaggcggacagaccggaaccggaaaggtgaaagccggaagtgatggagctgtggtgatcaaaggtctgaagatgggtgattacagagttacagaaacaaaagcaccagaaggatataacaagctgacggagtcatttctggtaagtgccgaaaagatcagggcgacaaggacggacgccagcacatatcttgatgaaaacggaaatgttacagaaagcgagactgagacaaaggtaacttatacaaatgcagattttgcagcaaaggtaaaagttgttgtaaataaatcaggaaaacttcttccggggacaggtggaacaggtgaaatgatctttacggtcagtggagtactgattgcaattgttgcaggagctgtcctgttgaatacaaaaagacgaaaacgaattgtatgatagtgaatgagccggaacgaaggggaagaattttcttttttatatggacaggaatcctttttgtgggaatcgcagtcatgctctatccaaaagtcggaaagctctggaatgccggtcggcaaagcagggtagtggatggatatgaaagatcagtggagaagctggatgccaggaaggaagagaaaatgatcgcacagacaagagcgtataatgtgatgcttctggaacagaataacccagtgccgaatgacaaaaatgctgatagttatggagcacttttgaatatgacatctgacggtgtgatgggatatctggaaattccggcaatccggttgaaacttccgatttaccatggaacgggtgatttcgcaatctgcaatggcgcaggacatgtggaaggaagcagtttcccgataggcggaaagggaacacatgcggtgctttcttcccacagaggactgccgggggcgaaacttttctcggatctggacaagctgaaggtgggagactattttacaattacagtgctccggcagacgattttctatcaaatcgatcggatcgatattgtagaaccggaggaaacgggcctgcttgccctggataaggagaaggattactgcacattactgacatgtacgccttacggtatcaataccaaacggcttctggtgcggggcgtacgctgtgaggtgacggagagagcggagccaatcttgacaggagagaagacgtattggagatggtatgctgcaatcggtcttaatgtactcgtggcaggcatgatcttgtgctggaaaaggaagaaaaaaagaagaggataaatataaatgagggggataaaaatgcagacagtatttgctgaaaaaacagaagagcggtcgctggatgataacagacatatcggggagcttttctttatccggatgtactgggaaaaagggaggattccgtctggaaatattctgtactggaaggatgccaaaagagaggatgcacagatcaatttcacaggatttgacgggcttttgctgtatctggatgaaacttgcgagcagaatggcgtgcttctgagaaaagcgcaggtcagacgatgccagaaaagaagacgttatctggagactgggaacgtgccggacatggaacagatgaaaaaatcggggcacgcagcaatcttctggttaaaggtgatgggaagagagtttgcctcgtttcagggaatcgtccacatctggggaagggattatccgtaccggagcggatttgaactgattattctgctgaaagatattgtaggatttacagagaggcgggggacaagaagaaactggatggcggagagaagctgttgatgaatattgcaaataagattttgcaaaatgattttttcgtctgcaaaggattgtgaagtcttaaaagacatattataatgacataagaaactacagacaagacggacaggagatgcagacaatggaattatgggatatttatgatgcagataagaaaccaacaggaagaacgatgaagcgcaatgactggtgtctgaagaacggggagtatcaccttactgttcttggcgttgtagcaagaccggacgggaaatttctgatcactaaaagggtaatgacgaaagcctgggcaccgggctggtgggaggtatccggcggtgctgcgcaggcgggagaagcgtcttacgatgctgtattaagagaagtcagagaagaaacaggactggatgtaagccaggcagacggaggttatcttttcacttacaagagagagaatccgggggaaggagataattatttcgtagacgtgtatcgttttgtgatggatattgatgaaaaagatctccatcttcaggaggcagagacagatggttatatgtttgcaacattagatgaaattaaggcatttgcggcagaaggaaagtttctgcattatgacagtataaagaaagcatttgagatgtaagtaaaataaaaatcggattatcggggaaatgacagatcgcctgataatccgattttttataaaacagaaactctgaaaaaatatgcaatacatagcgagtatctgtttctttctgctacttgcaatatgatgcaatcactttcaacaccttatccatttccagtggctttgcgagatgctcattgattccggcattctttgacttctggatatcttccgcaaaagcattggcgctgagggcaatgattggaaccgttggggcatcagggcgggaaagtccgcggatcgcctttgcggcatccagaccattcataaccggcatcataatatccataagaatgatgtcgtattcatatggctttgatttttcaaaaagctggacggcttccagagagaaaacagcaatctcaaggttcagttcattatcctctacaacaagaatatgaagatccgtaagatctgcggggtgactcctgcggcgcaccactcataagtattggtagaagtatgattttcactggtttcaaatacataagcacggtcgacgcctgtaaattctccgatcgatttgagcataaaattgataccgtcagccagatcttctgcttcatgaagcagggaaatctgatctgtcataaaacgttcggctttcagctcagcatataaagttgcattatccttgtcattattcataaggaagttcctctcaagtaaagtgtaaagtttataaaattactttaccttgtttttgcgaattcgtccacgaaaaatttaaaatacaaacaaattgtctggtggttgaaaaaaagaaggaatgattctataatttcaattagacgaaaaagattttgtcaggagataacaggaggaaaataaaatggcttgtacaacaatactggttggaaaaaaggcatcgtatgacggttctacgatgattgcaaggaatgatgattcaccgtcaggcgcttatatgccgaaaaaatttgtggtgattcatccggaagatcagccgaaggtatatgaatcagtgatttcgcatgtgaaaatagaattaccggagaatccgatgcgttataccgccatgccgaacgcagtcaagggggaaggaatctgggcggcaagcggggtaaatgaagcgcaggtaggaatgacggcaaccgaaacgatcacatccaatccacgtgtgcttggagcggatccgctggttacatatcagccgaagtcagacgaccaggaagaaattgcaggtggaatcggggaagaggacattgtatatatcgtgcttccttatatccacagcgcaagagaaggcgtgcagagacttggaagtattctcgagaaatacggtacttatgagatgaatgggattgcattcgaggatgtaaatgagatctggtggctggaaacaatcggcggacatcactggattgccagaaaagtgccggatgaggtttatgtggtgatgccgaaccagcttggaatggatgaatttgatctggaagatgcacttggtgagcagaaaaattatatgtgttctccggatatgaaggaattcattgagaaatatcatctgaacccgtccatggatggaaccttaaatccaagagatgtttttggaagccatgatgactcggatcatgtatacaatacaccgagagcctggtttatggaacgttacctgaatccaaattcatacagctgggacggaccggatgcagattatacaccagtatccgatgatattccgtggtgtatggttccggaaaagaaggttacagtagaagatgtaaaatatgttctgtcttcacattatcagggaacaccttatgatccgtatggagcttacggggacaaatcaatgaatggtgcttatcgttccattggtatcaatcgaaatgattttatgtctttgatccagatgagaccggatcagccggaagattcccgtgcaattgaatgggtggcatttgcatcaaatgcatttaatgtaatggctccattctatgcagatattgatgaaacaccggaatattttgcaaatacgacaggggaagtttcaacagagaacttctactggtcaagcagaatgatcgccgcgatggcagatgcttcttataaaaagtctattttccatattgagcgttaccaggaacatgtgatggcaaaggcacatcagatcataaaccggtatgatgacgatcttacgaaagaaagtgatatagcaaagcgtatgcagatcaaacgggaagcgaaccgggagattgcgaagatggtgaagaaggaaacttcggatacactgtctaaggttttgtatgaactgagcaatcagatgaagaattcttatgcgagatcggatgcataaataaaatacgagtgggaaaagaagagggcagaaaaatcataaaatgatgtaagtgttaaaaataagaaaaaagctgataaaaaaataattttataaacagaaaggtttgaattttgtagactaaggtattataatagcgtaggaagttgaaaacttcttaatcaaattcaaacaaaaggcaggtgaacagaatggacagttgtgatagtcatgggcgaagtatatacgcaggatgggaaaatggcagcagttcattctgtttgttcgtatagcatttcttatcctgttttcccgtattgacattcataattgaatattggatgaaagacagaaatgtggagaattttagactttgattctgcatgtttttgtgctggaaaaaggataaggagggcgaaagttatggaaaatacacaggattatcaggactaccaggactacagagctgagatcctgggcattgtaagaagcaatgcctctccgggaattatgagaaacaaactggaagactaccatgagaatgaccttgcagatgtattcccggatctctccgttgcagagcggcggaaattgtgccggattctgaatctggacatgcttgcggatatcttcgagtatatcgatgaaaagcaggctgctgaatatctggatgagatggatgtgcggaaagcagcagcaattctttccagaatggaaacagatgcggttgtagatgtactgcggatgattccaaaagaaaagagagctcttttgctagagctgatggatgatgaagccagaaaggatatggcagttattgctgcattcgatgatgaagaaatcggttcaagaatgaccacgaattacattgagatcagagagaatcttactgtaaagcaggcgatgaccgaacttgtcagtcaggcagcaaaaaatgacaatatttctacaatttttatggtgacagcggatcacaccttctacggtgcgatggatctgaaggatttgatcacggcaagacaggatacacgtcttgaggatctgatcgtgacatcatatccatatgtatacggtcatgagctgattgatgactgtatcgaaaaattgaaagattattcggaaaattctattccgatcctggataacgataataaacttctcggtgttatcacatcccagagcattgtagatctggtcgatgatgagatgggtgaagattatgcgatgttcgctggtctgactgcagaagaagatttgaaagagccactcaaagagagcatgaaaaaacgtctcccttggctgcttgttctgctggcactgggaacagttgtatcttctgttgtaggtgtatttgagcaggtagtaagccagctgacgatcattatgtgtttccagtcactgatcctggacatggcaggtaacgtcggtacccagtcactggcggtaacgatccgtgttctgatggatgaatcactgacaggaaagcagaaagtagaactggtattcaaagagatgcggatcgcattttcaaatggtgcgattcttggaattttgtcattcctcgtattaggactttatattgcacttttcaaaggaaagacctggacattcgcgtatgcggtatccggctgtatcggtctgtctctgatggtggcaatggtaatttccggtgcggtgggtacactgattcctctgttcttcaagaagatcaatatcgacccggcggtagcatccggaccacttattacgaccatcaacgaccttgttgcagttgtagcttactatggactgtgtggtattctgctgatcggagtgcttcatctggcgggataattataaaagagagtaaaacgaagtgcgtgtaggatataaatgcttttactgaataaaacggtaaagacagtacagtatcccacatgcatttcttttatagaaaataaaaataaaaaaatagatagaaactataggaatgattatctatagagaaaaacaatttgaaaattaaaatatctggtgctagaatgtaaaaagcatgtcggaataatatcagagatatgttaaagggaggaacattatgaaaaaaatgaaaaaatttgcagctcttctccttgcagtatcaatggcagcaggtatggtagcctgtggaagctcagataaaaaggaagagactacaaaaaaagaagaaaccaagaaagatgacaaagagacaaagaaactggaaggaactctgaaggttgttacaacaggggatgcttatcagcctttatttgataagtttacagaagaagtaggaccgaaggtagaattcatttccatgtcttcaggagaagttttatcaaagcttaaagcagaaggcggaacacctgcagctgacctgtggttcgggggcggaatcgatgcatttatggatgcaaaagataatgaccttcttgaaaaagtagattttgatgcagctgatgaacttgcaccggaattcaaagatagtgataattactggttctcaaaaggtgttactgttgtaggatttattgttaacaatgatattttaaaagaaaaaggacttgaagctcctaaatcatgggatgaccttacaaaagaagaatatcagggagaagtcctgatgtctaacccggctatttcaggaacaaactacgcagtagtaaacgctcttcttcagacaaagggagacgaagaaggttggaagtattttgaagctcttaacaagaacgtagattactattcaaaacgtggttcagatccaagtacgaagacagcagctggtgaagttggtattggtatcacatatatcaatggtacactggatgaactgaaagaacaggcagatgttgatgtaatctatccttcagacggaatgccatacgttccagaaggcgttgcagcatttgcaaatgcagacaatacagaagctgcaaaagcatttatcgaatggttcttctctgatgatgagaacatgaagatgatggctgaaattgacaagaacaatacctgtcttttggtaaaaccaagtctgaaaggacttgaactgaactttgacaaggatcagcttatgaaagaagatctttctctgttcggatcaaagagaacagagatccttgacaaatggagcactctgatgggagataaaggtgaagaatagaaaacctagagaaaaacgggcatcattttatgatgcccatttttataatatattggattattttatattagcagtgctggtagcaggtgtgttgatctttattctgtatccgcttctttgcatgatcagacagagttttgtgggagaagagggattttcgacagaagtttacaagagcatcttcagtgccaatctgcagcttgtaaaaaacagtgtttttgtaggtgttttatccgcattcttttcaacaattctggggctgcttgtatcaatctgtgtatggacagcagggaagaaactgggcaaatttctggaagcgattttgctgatcagcatggtttcgccgccgtttattgcttcgctcgcttatatccagcttttcggaagaaacggtctgatcacaaaaggagtgttcggactttcgctgaacccgtatggatggcttggtgttgttgtaatgcagacgttattcttttcttcattaaatgcactgatgattatcggaatgctgaggaaaatggatatgtcgctcgtaagagcatcttttgatcttggagcatcctctggatatacattgtggagaattgttgtaccactgttaaaaccggtactactcagctgctttttgctttcgtttatccggtcgatcgctgattttggaacgcctgttgtgataggtggacgttttgaaacagtttcgacggaaatttatatgcaggtaatcgggtattccagactggataagagtgcggcacttaatgtactgcttctgatcccgacgattcttgtttttatcctgtaccgctatctaatgcagaaaaatgaaaaagtcatcagcggaaacagtaataagacggtagaagcgggagatacattccgggttcgtgggctgtcagcagtgattgtatggctgggcgcaggtatcttttttgtaatgatggtgcttgaatacggatccatttttctaaacagtttcagtagaaatttacgtgggaaaatcacatttacaacgatgtatctggacgcacttctggaacggaatatggatacatttatccgaagtgtggaatatgcgcttattgtggcaatagtcggcagtctgatcggtattttactttcgtattatattgaaagacgaaagataaaatttggcggagtactggactttattattacacttccgtatatgcttccgggaagttgttttggaatcggatatattctggcatttaatcatgaaccgttaaaacttaccggaacagcggtcattgttatcttgaatatgatctataaacagatgtcaattacaacgaaggcttcggcatcctcccttttgcagatcagtacagagcttgatgcagcagcgcgggatcttggagcgaataaatttctggtaatgaaagatgtcattcttccgaatgtaaagcaggcatttgcaacgggatttatcaataattttacaagtgcgatggttacggcaggagcagttattttcctggtgacaccgggacagaagattgcagtatttacattatttgattgcattaacacaggtcggtatggagaagcatctatgattgcgacatttattattgtgatcacaatttcagtaaatgtgctgttttcgataattgttgcatggaaagggaaaaagaaacgtgtatttagaactgaaaaacataagtaaaagttttggtgaaaaagaagtagtaaaagatttatcactctcccttccaaagggagaactgttgtgtcttctgggagcatccggctgtggaaaaacgacaacactcaaaatgataagtggatttttaaaaacagataaagggcaaatcctggttgatggccaggatatcaccacactggctccggagaagcgtccggtatcgactgtttttcagtcttatgcattatttccacatatgagtgttctggaaaatgtgatctatggtctgaagttccgtggcatccgaaaaaaagaagccagagaaatgggtatggaatatctgaaaatcgtagatatggaagaatatgccggggcatcgatcggggaaatttccggaggacagcagcagagagtagcactggtcagatctctgatcacaaaaccgaaggtgcttcttctggatgaaccgcttagtaatctggatgcgaaactccgggtaaaaatgagggaagaaatccgtgaaatccagaagaaatatgaaattacaatggtttttgtaacgcatgaccaggaagaggcaatggtacttggagatcagatcgctattatggatcagggaaagttggttcagattggaaagccggaagaggtgtatctgcatccacagaatgattttgcaagagatttccttggaatatccaaccgttttactgatatccatggaaatacaatatgctgcagaccggaggaactggaatttgcagcagaaggttctgtgaaaggaattgtaagacaggaagaatttcttgggttttacagacagtattatgttgaaacaatgaatcatgaacatattattgtacggacagacagaaatataaaagtagaagaaggcaaagaagtgcaacttcgggtgaaataaaaaagacactgtgcaaggtgacaatatcagtttgatatgctaccctgcatagtgccttttttattttgaggaatgaccggtcagacgtgcatcatccctgacatcacacaacctcctgcagcaccggcatttttcagttcgtgcagttgtgcttcatcaattttgattccgccaatgccataaaccggaatctgcacagcttggcatacattctgcagaaatggaagtccccgtggcggaagccctttcttgcagtcggtaacataaatatgtcctgctgtgagataggaagttcccagcttttccgcttcgactgcttcagaaacagaatggatggaagttccaactgtatgaaaatcggaaaccactttcggattttcaagcaaaagtggaagtggtaaatgtagcctgtcgcagccgagttctctcgcaacggctggataaaaatgcggaataaacggaactttaaactgttcacagatttccttcacctgccgggcaagagaaaaatattcctcttccggcagatctttttcacgcaggatcagagctttcggatgcagcttgcagacacgggtaatctgttctgtaaaaggacgggaacagagatggcggtttgttacggcaataagatctctatacatagatataatcactcataaccggctgcatattattggaaagaagtgcctgataaacctcatctacggaacgtccgtcagaaatctcgaactggtcatctcccttatcctcaatatcatctacatggcttccgattccggtgctgactccggcagagatttttgttgcagaaatctgtaccagattgtctcttacacgcgcacattctcttgtggataccgtaatgcttgcaaatggcataaacagacgataagcgcagactacctgaaggagctgtggctcatggacgtccatcggattgatccggtcgttgttgatgatcgggcacagcctcggacaggagaacgcgatctcagcatgcgggtattttctctggagaagataagcatggtatccggttgcaaaagcatcttttctgaaatcatccaggccaagcagggcaccaaagccgacaccacgcattccgcccatcagtgcacgttcctgtgcatttacacgataagggaagatcctcttatgcccggcaagatgcagggtttcgtatttgtcggaattgtaagtttcctggaaaacggttacatagtctgcaccgcattcgtggagatatgcatactcatctgagttaaccggataaatttccagtccgataactttaaaatatttgcgcgcgatcttgcaggcatttccaatatattcgatggtagatttactgcggctttcaccggtcaggatcaggatttcctgaagccctgtactggaaattgcagccatctctttttcaatctcttcgtcatttaactgcgcacggttgatcttgttgtggcagttgaaaccacagtaaatgcagtagttctcacagtagttggcaatgtagatcggtgtgaacatataaacgctgttgccaaaatgcttacgcgtctcttcctgggcagcctgtgcaatttcctccagaagcggaagagcagcaggagaaagaagagcagcaaaatcttccggtgtacggatgtcgtgtgcaatagcacgttttacatctgctttcgtatatttgtcataatcataagcattcatggcgcttactacctgatccatcacgtcagaaccaatgtcctccatatccggaagataggtcatatgatcgatccggttctttttctggtcctccagaatttcttcacttaaaatactttcgttgatatgtgaattttccattttgactgcctcctaattctctaagaatcctgtcagaggtgaggatgcgcttgcgcctctttcgatggtgcgtcccagtccggaaagataagcactgcgtccggcttcaatggcttttttgaaagcttctgccatggcaggaacatttcctgcagttgcgatagcagtatttgccatgacagcggaagcacccatttccatggcttcacaagcctgggaagggcgaccgattccggcatcaacgatgatcggcagatcgatctcatcaatcaggatctggatgaaatcctttgtgctgagccctttgttggaaccgattggagagccgagcggcataatgcaggcagctccggcatcagcaagtgctcttgcagcattcagatccgggtacatatatggcatgacaacaaagccttcttttgcaaggatttctgttgctttgatggtttcgtagttgtccggaagcaggtatttggaatcatgaacgacttcaatctttacaaagtcgccgcatccgacttcacgggaaagtctggcgatacggactgcctcctcagcattacgtgcaccggatgtatttggaagcagggttacattgtccggaatatagtccaggatatttgcaagaccgccttcatttgcgcgacgcagggcaagtgtgatgatctgagcttctgctttttcgatacaggcttttacaagatccagagaaaatttaccggatccgagaataaaacgggaagtgaattcatgacctcccaggataaatttatcttcatttgtactcataataaagttccttctttcttatatttttaaatttcttcttcaccgaggatcagccgcgtgatcatgttggcttcatgtgcggcacagatggcaacacgcggcgccatcagtccatgaccgtaagttggtgctgtcacgccatcaccacacagataaaagtttttcatgatccgttttgtgataatggtattgctgcttccatagccggccattccggttgcggatacgagctttttctctggaaaatgttccagaattccattgaccagcattgctttggcttccggattatcaaaagcttcgcagacaattgtggtatctgcaaataattcctgcagattatcgtccgtaacttttacacagtccgtgcggatatccagatacggattgatcttcagaagcagggatttcagggcatcggtcttgtacattccgatatgctccatgaaatattgctggcggttcagattggtaatgtcaactacgtcaaaatcaatcaggtgaagatgaccgacaccaatccgtgcaagcgcataagcaacattagagccaagaccgccaagccctgcgatcgctacatttcctgccgagagaagcttctgcgtctccggtgaatgtcgctcgtcaagggcggtgtagatttcttcttttgtaagtgtatgatacatgatttcttagcctcctcctacaaaacttacaacctccagacggtccccgtctttgagcatggtgtcagaatagctgtattttggtaaaatatcaccattcatttcaacggcgatccgtttgatctgataattgttttgttccagataatccgcaacactgagcggtccggtcagagtaacttctttaccattaactgtaatcatggaaaaacctcctttcaaaacggaaaagttcttaaaaatgaaaaaagagtacacaaagaattacacccgtggtggtgtaccccttcatgaactctcgcccaatctcaactttaccttattcattttcgtgtaaaccctggttgaatgtggaatttcatgatgttggggtcaaaaggtattttgacccctttgataccagattgctacgtgctttgcactctcgcaatcctcaaaaacattcgtaatccgctcatttttctttgaaaaatggctacttactcatgtttttggcgggtcaagaggtcaaaaatcctcttgcaagcaagcttgcatcagctttctgaccttttgaccctggtatcatttcatattattataagaaatcctgtttctcaaatatcatcagagtatgctgatggtatttgacgccgtatatcaaaaaaagagagataccaatgtatctcccgttatcatcaaaatatacgttcctacgttggcattatccaaatcaggtatatgggtcgaagttctgaacttcctctcagcctgtcaaacaagctccccgtttcatttacaaaattcagtataattcggttgggaaaaaatgtcaatatcaatataaaaatatatccggtcatattctggagtctcatattctggagtcagatgcaggtgtcacggacaaattgtatattacaggaatgctttcgcgaagcggtcatatgtttttgtaacgcggagtatggaaaaatgcacaaaaaacagagcgtactctaaaaaaatagtgtaaacgtgccgaaaatgccgaaaatccattgacaaacgccctttaaaggggtaaaacaccactatggcaatttgataaaagcttatcaaattaaaatactatataaaacaatttttactggaagagagaaagagagggataagtatgaatacattagttattgtactgatcgcagccgttttactttgctgtgcatatgtattctacggacgctggcttgctaacaaatggggaatcgatccaaaggcagagacaccagcaaagaaattcgcagatggaaaggattacgttccgacagacggctggacagtattcagtcatcagttttcgtcaatcgcaggtgcaggtcctgttaccggcgccattcaggcagctgtatttggatggcttcctgttttactgtgggtactgatcggaggcattttcttcggtgcggtaacagatttcggagctttatatgcgagtgtaaaaaatgacggaaagtctatgggacttctgatcgagaaatacattggtaaattcggtagaaaattattcttgttgttctgttggctgttcacacttcttgttatcgcagcatttgcagatatggttgcaggtacattcaatgcgtatacagaagtcgacggagctttaaaacttgcagatgcagcaaagacaaacggagctgcaggaactatttctcttttattcattgcatttgcaatggtatttggtctggtgcagaaaaaattccagttccgcggatggaaagaaacagttcttggtcttgtacttacagtagcagcgcttgctcttggtatgcttgcaccgatcacagcaggtaaagatacttggacttatatcacatttgtatatatcttctttgcagcagtacttccgatgtggcttttaaaacagcctcgtgatgcaatgacgacttatatgttcatcggaatgatcgccggagcagcacttggacttttagttgcacatccgacaatgaaccttcctgtatttacaggattccacaacgacacattaggagatatgttcccaatcctgttcgttacggtagcttgtggtgccgtttccggattccacagcctggtttcatccggtacttcctcaaagacagtatccaatgaaaaagatatgctgaaggttggatatggagccatggttctggaaagtcttcttgcagtcctcgcactttgtgtagctggtgcagctgcagcagcagacggaacaccggcagcaggaacaccattccaggtattctcaagcggtgttgcaggattctttgaaatgttcggagttccggtttatgtagcacagtgcttcatgaccatgtgcgtatctgcacttgcactcaccagtctggatgcagtagcacgtatcggacgtatgagtttccaggaactcttcagtgtagatgatatggaacatgcagaaggatggagaaaattcctttgcaatacctacttctcaacaatccttacacttgtatgtgcctatgttctgacacgaattggatatgcaaatatctggccattgttcggatcagccaaccagctgctttccgctctggtacttgtaacactttgcgtattcctgaaagtgacaggaagaagcaacaaaatgcttttcccaccgcttattatcatgctttgcgtaacaggaaccgcactggtagaaagaacaatcggtcttgtaaaagcttaccaggccggctcagcagtattccttgtagaaggacttcagctgatcatcgcagttctgctgatggcactcggacttgttattgtgatcaattctctgaaggcttactttggagctaagaaagagtctgaagcttaggatttataaaatatgacgaaaagggatggcttgtcaaaatgatgggctgtctctttttttgattgactttttttaaaatcttccctaaaatacttaggaaacgaagtatttaatgcgaaaaatgataaagtaaaatatcataaggcaaagggaggtatcatgcagacaggaaagaagatcaatcagatttccaaccgtctccgtagacggtccagggcaatccaggaaacaatcgggatcagcggtgcacaggggaatattttaaattatattttagtagaatctcagaacagatctgtctatcagaaggatattgaacaggaattcggacttcgtccttccacggcaacagagacactgaaatctttggagaaaaatggactgataaaaagagagactgatccaaatgatggaagatataagaaaatcgtatttactgaaaaagcagagcagatagaagctgtgcttaagagtgagatcgaagagtcggaaacgattttgctgcagggagtgacaaaagaagaacggcaggaatttctgcggatcgcagagaaaatgttgcagaatctggatacttttcctgcgaatacggtaaagaaaaacgcaggcagaaaaaaacaacacggaggacggacagatgaatgaaaatgaactgatgggaagtatgaaggtgtcaaaagccgttgcgaagatggcaataccaagcgtgatcagcagtctggtcacggttgtctacaatatggcagacaccttttttgttggacagactggggatccactgcaggtagcagcggtcagtctgaccaatccgatatttattttactgatggcatttgcaaatatgtttggtatgggtggaagtgccgttgcatctatggcgatgggagaaaaaaatgagaaacgggtaaagaatacatcggcatttgtaacctatgcatcactgatcgtcgggattttatttgctttgatcctgattttctttgtgaaaccgatcctttacacatttggtgcgaacagtcagacttatgagatggcaaaaggttatacatttcacgtttcctatggtgcaccatttatcatctggtcagcagcgtcaagctttatcgttcgtgcggaaggtgcaagcagtgaggcgatgatcggaagtatgatcggtacagttgccaacattgttctggatccggtatttatcagcggacttggaatgggggcggcaggggctgcgattgcgacaacgatcggcaatattctggcaagcatttattatctctggtatttcatgaaaaagagtaaaagcttttccgtcagtccgaagtatttcaaatgcggagagcaggttttatcaagggtatgttcgatcggttttccgaccgcaattttttcagcactgatgagtgtatcaacgatcgtgctgaatcagattctggtcaagtacggaaatgcaccggtggcggcgattggaattgtattcaaggcaaatatgtttattaccttccttcaaatgggacttgcaaacggcgtgcagccgctgatgggttacaattttggggcaggcaatcagaaacgttttatggaagtggactgttttacgaaaaaatgctgtctggtcgttggaatcctggcgacggcattatttttcttttttcgagaaccaattatccacctgttcattaacgataaagacgttatatattatggcgtgaaaatgctggctgcatatatggtttccggaccgtttatcggaatcctttttgtaaatatgaactgcatgcagtctactggagatgcacttcctgcaacgattctgtcggtgctccgacagggacttctgctgattcccttactgtatctgttgaatgcagtgttcggattaaacggagtcatttacggacaggcacttacggattgcgtggcgattgtactgtccatgtatatctggggaagaaagaagagaaaattaaagagtgaataagtgagagaaaatcaggtgtcgggggtgatgcctgtttttttcttgcttataaatataacgtgcaaagtggaaagaatcattgcggacacgcatataatagtcaggtacaggaaataattcatctgaataaatgtaagaaagagaggctgtttatggaagagcgagatgatctggaacagatggcatttatacagaagtggaatgacggaaaggcagaacgggagaaaaagcgagagcagatgtggaacgggattctggagaaggctgggataaagaaagaagaaaagtaaaaaggaaaatgattttttagaaaaaatgaaaagaactcaaataggaactcaaaatttaagtttctgtttgagttctttatttgagttcctttaagaaactaaaaaaatatgctattatcttaaaagtagagagaaggaagtaaaattacagcagaaaatttttgaagaactaaaaaatcaaaggggaagattagcgatggtaaaaatagatttaatcaccggctttttaggttccggcaagacaacgtttattaaaaaatatgcaaaatatcttctggataaaggaatgagcattggcatccttgagaatgattttggtgcggtaaatgtagatatgcttcttttgcaggacctgatgggagataactgtgagcttgaaatgatttccggtgggtgcgacaaagagacgcacaggaggcgtttccggacgaaactgatcgcaatgggaatgtgcggatatgacagagtaattgttgaaccgtccgggatttatgatgtagacgaattttttgacgttcttcacgatgaaccactggataagtggtatgagattggcaatgtgattacgatcattgacgcaaaactggagccggaattgtcagaagaagcagactatctgcttgcgtccgaggctgcaaatgcaggaagcatcatcctcagcagggcagaagaagcaacaaaagaacagattgaaaatacaattgaacatttgaacagagcgcttgaacaggttcagtgcaagcgaaggctggatcgggaaatcatgagaaaagatggagcagagctttcgaaagaggattttgataagatcttaaagagcggttatgttgcagaaaattatcgaaagatggagctggatgagaaaaaaggttttgattcgttgtattttatggaattgaaaatttctgcagatgaattgaagacgcaggttgcgaagataatgcaggatccggaatgtggcggtattttccgggtgaagggattcgtgaaagatgatgcaggaagctggatgcagctgaatgcaaccggtcatgagatcagtatgaagccgatcggagacgggcaggaggttgtgatcgtgattggggagcagttgaaggaagattgtatacggaagtatctggagaattagaaagtgtaaaagagcacatcaaaagcgatgtgatccggtcagtatgctgaaaacagttttgtttgtgtaatacagctgttattgtatccataagcaacaggacgcatgaaaaaactttcgttttttcatgcgtcctgttaatttattgtttttggtaaatgatatgttttatacgaccgccatccataatgatggtatcattttcagcttttacatacattacaagatttgcatccattcggaagataatacttcctgatgttgattggtaaagtgttgttttcccatgacgacgcatatggatttcgcaggtattttcaactttcactaatttcatgaaggaatcggtttcgtcgttgtaatagattccttcttggaaaagtgccggatctgcaggtttggcaggggtcaatgtaagtacacgaccaggaagccgataaaggattccgttatctgtgaagtagatcttttcatccaatgaaccaatgcgataaccgccatcctcttcttttaccagttctgtgcgacaccattctctttgcatataaaaaataccgttttgctctgtgatatcaacaaacattggatcatccggaagtgctgtcaggaatacaccgctgtgagctggtgcattttcatgttccggcacggctggttcggtacaatccggtaatccgagtacgatgcaggcggctttatcggcaagcttagacattgcgtaagttgtggtgttactgatcagtacaagctccagttctttttccggaatgcaaataatttcaccacggtatgcagcatcggcaccgccatgaccgaatacatccagaccatgaagcttatgggtgatcagtccgccgcagtattcagccgtttttccattgctgagaaggacaggtttcttcataagctcgataatttcaggatcgatcacatttggatgaatgtactcatctaatactttgcagagatcggaagcacaggtatttacagaggttggcccgtaaagtgcatagttcagtggattgtagtagaatgtatcatcaccttcgtcctggtaagagtaagtaagatccggaacaatctgtgtaaagctttcgcggacaaaagaatgtgtcattccgagtggagtgaaaatacgttcttttacaaattgcgggaagctcatttgcgacagcttttcaacgataagtgccaataaatggaaaccggtgttactgtataaatactgtgactgtggttcaaagttcagcgatttctgaagagatatcgttgtattgatatcatccatgtcaatctgatcgttgatcttgataccgcgtaaaaataagagttcccattggtcgcgaagtccgctgacattattcatcatctggcggatcgtaatcggtgtttcaatgttgatatattcatctaaatattttctgatgttgtcatctaaatcaagttttccttctttccagagaagaagaatagacataacagtaaattctttggaaatcgatgcgacatggaaaatactttctttatggatttttaatttattttcaagatttccatatccaaaacatttttcgtaaagagttttaccgtgctggcgaatcaatacctgagcgccagggcaaagaccgcgatcccacatacggaaaagctgatctaattgttctgtcatatttgaattcattacaaaaatactccttctgataaactatttttttaggattttttcgaatgcataaagccagtttttgcctgcaagcagagaaatccgttcatctgaataattatgttctttcatatccagcactctatttttgcggtgtacagcgacatcagttagcagttcaaaatgtgcatcaacaatatatttcataatcgtgttttccttaataaactgattgtgaaaagtaaactattatggtcgcttcttcatctgatgtattcaagtagttatgtaaacaatttttagggatatagaaactgtcgccctcgtagatcatataagtgctgttatcgatgcggagttctaattcccctttgagaagcaggagactttcatcgtaattaccatgtgaaatcattttctcagtcacccaggtgttaggctttaatctcacaatgagtccggtcatttgtgcttcttgtgcgtttggaagtttagaaggtgtaaaaatagagtaggaaacatcgatttttatgtaacttatttgttttcttatagaagaacaaaacatacagttgttgaaatattataaagtaataaagtaaatgtgtcaatattttgacataatatacaaaataaattatactgacagtaataattgtactgtgagtaaaaaacacagagaaaatctttttcgtaaaacgaaactcaaaaaaaggatgtaaaggaggaaggaaaaacatatacattccatttgagaaaagatgcaaaatggtcagacggaagtccggtgacagcaaaagatttcgaatattcctggagaaggatcggttggatgtaaatttgcatccagatgtccatatgctaccaacgctgtcatgaagaaagaccaatcttcagaaatgttggaaatgaacattatgtagcctgtcatctggtagaataatgcatttaactttgctacaatggaagtagcattgaagcagtcaataatctgaatatttgattagaggagaaaaagaaaatgcatgaattaacacaattaatcaaagatgatatgcgtccggctcttggggtaaccgagccgggagcgatcgcatatgcggtttcaaaggcaaaatcctacgttccgggagaactggaacaggttacgcttttgctgaacagcggtatgtataaaaatgcatatacatgtggtatcccgaacagccatttttacgggaacgaatacgcagcagctcttggagtcgtagcagggaaaccggagaaagagctggagagtcttgctgatgtaacagaagctgacaatgtggcagcagagcagttggtaaaagacggaaaaattgctgtaaaaatgagtgagatcacaagccgtatttttatagaagcctgtgtaaagacaacaggcggagaggctatggttcagattcgcgatgcacatacaaatattgttcgtattgaggcaaatggagaggtgcttcttgagaaggaagaagtttctgtggaaggtggacacgaagaaaaaccattgattcacaattatacattaaaacagatttacgaatacgcaaaagaagttccggcagaggaaattgaatttatcaaggctgcctatgagatgaactatgctctttttgaagaaggaatccagaacccgagaacaacctatgcacggtatctgcttgagaaaaatggcggaaagattatttcggatgatgagttaaagactgcatctttactttgcaatgcagcaattgaggcccgtgtgatcggacttgacagaccagccatgagcattaccggttccggggcacatggaatcattgcaaccatgcctctttacggtgtttgcaagatccgtggattaagcgatgaaaccttatatcgtgccaccgcattaagctatctcatctgcatgtatatcaaagaatattccggtaagctttctgctttctgtggctgcggcattgctgccggtacaggaatggcctgtgcgttggttttccttcatggaggtgatgagcatgccatggcgagaacgatcaacaacatgtccagcagtattaccggtatgatctgtcatggcggaaataagggctgtacgatgaaaggagtcgtggcggtaaatgccgcatttcagtcggcggattttgcaatgcatgaaatctttattgatgatattcatggaatcaatgggtttacaccggaagataccatgcgtcatatgggagagatcgcatcaccgggaatgatcggaacagagaagacgattgtagatattttacaggaaaaaggggaatagaaagtatatatagggtgatatttgaataatgtaaaagcctttaaattgattgaaaaagatcagtttgaaggcttttgttttctttgaagaatatcatgaagaaatatcctactgtgcaaaacattgtttagtaaaactgtaaattgtgcaacgtgtcggaaaaaagtttcgtttacatgaggcattgcaatgaaatgcacaaaatgataagcttgaaacatacaaaacgagtttactaaagactttagataaagctaggtgagaaaaatgaatatacgagatattgccaatttggcaggtgtgtcagcttcgacggtatcgaaggtaatgaatgggaaagataaggatattagcgaagaaacaagaaaaaaggttttggaggtaatagaacgagaacattatgttccatattttaaatttcttgataaagccggtatgaaaaatcgacttgttggtttgattttgcaaaagaataatcaggaaaaagaaagatacatagcagttgctgaaagaatagcacgtgaaaataattatggtcttgttattggatattcggaagatgagaatgatacaaaaatattgtgtcaggacatgattttgaaaaaggtatcaggaattttaacagaagattttgtaaacatagcggataagagagaaaagggggttatcgttaattacaatgataccagtggattaaatgaactgaatgaaacgattttttattataaaatatctgaagcagtagaactggcagtagaaaattttgttcaagaaggacatcagaaaatagcttgtattgtgaataagagccagattggacttttaaaagattataaattggcaatgcaaaataagaatatgcaaataaacccagcatggatgtatatttatgaagaaatagaagagtttgggatatcacagtttattggagaaagcgaaacagctattatttgcggtactcctgaaatagcatgtcgtgtagcaggaattttagaaaaaagaaaaacaaatattccagaggagctatcaattatcgctataggcgaaggaaaagaactacagtatgttagtggagggattacagctatagatttcccaattgaagagatggttagtgagggaacaaaatgtttattcgaaatggataaaacaggacaaaaaacggatacggttagaatgtgttcgcctcaaatcatacatcgtaatagtgttgcaccaccgttgagagagaaacaaggagaaaagattatcgtagtaggaagtatgaacatagatgttacgatagaagctgataaaattccaggagaaggggaaaatcagatggcaagtaaagtgtatgttttccctggtggcaaaggtgcaaatcaagctgtgggtgttggtaaattaggtggtcaggtgtatatgatcggttgcttgggaaatgatatagatgggaaaagaatatacacaaatttgattgaaaatcatgttcatatggagggggtacgatttgattcggttttgccaagtggaaaagcctatatccatgtggataaaagaggagaaagtgctattacggtctatgccggtgcgaatacaaatttaagtattaaacatctaaaaaaatatgaatatatatttgaaaaagcaaaatattgcctgatatctacagaaataccggaatctattatagaatatacggtcggatattgcgaagaaaatgaaataaaaatcatacttaaaccaacttcaaaggtaaaggatgaaattttaaataaaattgattattttgtacctaataaaaaagaattatttactttagttccagaaggtacaacgattgaagaaaaggctgaaatattaagaaataaagggatacaaaacgtaattgttacattgggagaagaagggtgttatttaaagaatgatgagtattcactcttttttgaaggaacaggatttgaggccgtagatacaacgggaggggctgattcatttattagtgcacttgcagtttatttaagtgaaggtcataaattaatagaatctattgattttgcaatttatgcatcaggaatcagcgttacacgttatggtgtacagccggctttgccagatagaaagtcggtagatatatatgaaggagaaattcataaaaagtataacgatagaaggaggatgaaaaaagagtaatgaaacgaatattggtagttggaagtttaaacatggatattgttatagaaactccgtgtatgccgaaagctggtgaaactattgcagggaaaagtattgctcagataccaggtggaaaaggtgccaatcaagcatttgcagcaggtaaattgggcggaaacattgccatgatgggagccgtcggtaatgatgaaaaaggtgaaaaacttcttgaaagcttaaaaggtgttggagtagatatttccagaatagaagtaatgaatgatattccaacaggacaagcttttattacagtagatgaccagggagaaaatgcaattataattattgccggtgctaatggtaaagtcacaaaagaactgattgacagtaatctggctttgattaaacaaagtgatattataattatgcaattagaaattccattagagatagttggatatgtgaaaaaaatagtggaagaggatggaaaaattgtaattttagatccggcaccagcgataaaagatattcctgaaaatatactgaaaggtattgactatattaagcctaatgaaactgagttacagatattgacaggaatggaagtgaagaacagaaaagatataactgaagcagcaaagatattaataaagaaaggagtaaaaaatgtaatcgttactatgggtggagatggctgtttgtatatcaataaagatatagaagaattttttccggcatatccggtaaaagccatagatacaacagcagcaggcgattgctttacagcagcatttgcgctggctttaagtcaaaacaaaaattggaaagaagcaattgaatttggacaaaaagcttcttccatagcagtaacaagaaaaggtgcacaaacatcaattccgactcgtgaagaggtagacgaaatgaaaggaggaaaaatgtaaggtggaaaaggaaaaaattattattgattgtgatccgggctcagatgacgcactggctattatactggcgttatactcaggaaaattagatttaaaagcagtatgtagcgttaccggaaatggagcattggatacaacgacaaggaatggattgaatattctatctttgtgtggcagagaggacattccgttatatcggggatctgcggttgcattagaccagaagcagccggaaacagtgagtgcatttggagatgatggtttaggcggttttgcccatactatcgcttcggataaaaaagaagaggatcagaatgcagttgattttcttgtggaatatgtaaatgggcatccgaaagagattacactttttgccataggaccatgtaccaatatcgcacatgcaattcgtaagtcgcctgattttgccggaaatctaaaacgattaattattatgggtggggcaaaatatacaggaaatatgagtcctgtggcagagtataatttctgggcagacccaatggcagcacatgaagtcctgatgtctggtattcaggatgtgacaatgattggacttgatgttacaaataaaattgctttagatggcagtatgcgagaaatattaagaatgttaaatactaaattgtcaacatttgtatataatattacgcaagaaggaatggatgaaaactggagatcaagaagaaaagcagtttcaccgatgcatgatgtattaacggtggcatatttcttggacaattctattgtaaagctaaaaccggcatatattgatgtggtgacagaaggaattgccagaggtcagtcgattgtagatattggtggacactggaacgaaaacaaatgcaatgcaaaatatgcatatgatgttgatgtagttaagttttataagttattttataaggaaatatttaacgaagatattacagatttagttgagggaaaataggaggaataaaaatgaagaaaaagaatgaaacattttcaatgatggtaattttattaattccggtagcgattgcaattaatattgtcggagggcagatgacctcgatattaaaaataccggtagatttggatatgataggtgttattttagtcggtgcattagctggaccacttccggcagctgttacgggtgtattaacaaacttaattaacggtatttttgatccaacatggattccatatgctttctgtgcattctttattggaatttcatcaggattgttatcaaaatataatatgatgacaaaggtttggaaattagttatttcaggaattatcattgcattagtaggaactattacagcaacaccgatcactgtatttttctttggaggagcaactggtggtggtgcttccatgttagcagcaggattaatggcaaccggaaaacagattttagagtcagttttatcagtttatattgtaacagaaagtgtcggtaaattaatttcagtctttattgcatattttatcattaaagcaataccggaaagatctctcgttaaatacaaatatggagaaaaattcattaaaacaaagagtaactagtacatattttaaggagaatgaataatgaagcaagagaataaaattgtcgggctctacccgttaacaaaattttatttagcaatagttctggttgttttagatatcattatgccggggattttaagtaagttggttgtgtttgtaattattaatatcatagctgcactaagtgatgtctggaagagcttcatccgtaaagtgagaaattcagtcggtgttctatttgtgatattgttgtttatacagacatttttttacccaagaggggaagtaatattttctttttggatatttaatgcaaagttagaaggaattctatttgctttaaaacttggaattacattaatgggagtaggcggtagcttgatctggttcttttcggttacacaggaaaaggattttgtattagctttggaaaagagcggaatgagcgcaaaagcttcttatgtggttctatcaacacttcaaatggttcctgttttaaagaaaaaatcacagacaattatgaatgcacaaaaagcaagaggagtagaaacggaaggaaatcttttagtaagagcaaaggtttttgtgccgacgattattccacttgtattaagctcgatagccggaacagaagaaagagcattgacattagaggcaagaggattttcatctgggataaagccaacacatttatatgatatagaaaaaacagaagcagataaaaaagcagttgtaataattactttattaggagttttaggtattgcagggagggttgctttatggcttatatagatatacagaatgttacatatacatatcctttgactaaaaccccgagtattgctgatgtaaatttatcttttgaaagaggaaaattttatgcgatattaggtgcaaatggtagtggaaaaacaacattgtgtaatattataagaggttttattcctaattttttccaaggagaaatgaaaggaaaggttattattgacggaaagaatctcgaagaatatgagatgggagaaatagcatctaagataggatatgtatttcaaaatccgtttaaccagattacaggagccagggatactgtctatggagaaattgcatatggattagaaaattttggagtgcctgtagcggagataaagacgcgtgtagagaaaatcatggaaattaccaatacaacgtacttgcaggaaaaaaatccatttgaattatctggtgggcagcagcagagagttgcactggcatccgtattggttttggaaccggatattttagtaatagatgaaccgacatctcagttggatccacaggagacggagcgtgtttttgaaatcatcaaaacaatgaaacaaatggggaagacaattattctggtcgaacataaaatggaattagtggctgaatattgtgatgaagtagtggttttgcatcagggaaaagtaattcgtcatggtgataaacatgacgttttatccgagattgaattggaaaaatttggggttatgcttccgttaacagtttatctcgcgaatgaattgaaaaaacatggggtaagaatgaaagataacattattacttcagacgaaatggctgatcagcttcaaaaaataggaaagaaggagtagaaacatggggattattgaattcaaagatgtgagttttcagtatccgaatggtttttccgctgttgaaaacgtaagttttgaaattaatgaaggagaagcaatcgctattataggtcagaacggtgctggaaagacaacaactgtaaaaatgataaatggattattaaagccaactcatggaacggttttgattgatggaatggatacaaaagattatacaacagcacaactgtcaaaaatcgcaggatatgtattccaaaatccggatgatcagatttttcataataatgtcgaagatgaaattagatttggacctaaaaaacaaggattatcagaagaagaaattgtgaagaaaacggaatgggcagctaagttatgtggattatcagaacaaatgcaggaaaatccgtataatcttccactttcaattcgtaaatttgtttctattgcatctgtattggcaatggatgataaaatattgattttagatgaaccaactgccggacaagatttaattggaattaatagattggaaaatattcttacagagctgaaaaaagagaataaaacagtggttactataacacatgatatggagttcgcagtaaataattttaaaaaaatatttgtaatgtcacataaaaacctgctaagagtaggaaatgcaaaagaaatcttttcagatgatgaattattaaaagacagtatgttgaaaaagacttatatcggggatttgtgtgataaattaaacttaaatgagaccgcagttacaattgaggaattcttaaaatattttgtttagaagtagatggattttttaggctcaagaaacttagtaagggttagctgaaatggctgaccctttttagataattaaaaaattagtaaaaattgattaacgagttgaaaatttctatagaatttgcatgaaaaagaattgtagtatattatgaaaatgatgatgttgggggcaagaggtcaaaaatcctcttgcaagcaagcttgcatcggctttctgaccgtttgaccctggtatcatcataaaaatgcatagtaagaagaaaggaacacaccatggatttcaaatactgcaaattagaaattttcatcccggaaacacatcttccggctctccagaaaaccctccaggaagtagatgccggacatatcgggaactacgattcctgtatgtcatcaagtgaagtgatcggatactggcgtccgcttgaaggctgcaatccttatattggaaatgaaggagagatcagcaaagaaccggaaataaaggttgaagtcactgtatttacagaagcagttgacaggacaattgaagcaatcaagaaaattcacccgtatgaagaaccggtgatcaatgcaataccgatcctgagaacttcgttttaatgtaaaaaaggaagcttgaaaggcagaacagaaatagtaaaaagtgaacgttcagatcagagaaaattgattctaaaatttgttaataaagtaacggaaaagttgcataaagaaaaacatcttttttcaaataacaagcctgattattggcaaaaaaattgtagaaactgtacaaaaagtatatttttgaaaaaattatttgcatataattgtgcaatgtgatatagtgaaatcaagttgaaaaagcaattgaagagagatgccgtgacaggagagcgaatgttatatcagccgtgaggctgttacaagaggcgctctttttttgtgtatacgatgagccaagtgcagaggttgtacaaagtatacagagtgggcaggagcatcctactcgatcatattatgaggggtgaaaaaatgagcagtttttttcatgaagcagtagaagaaaatccgatcattgcagcagtaaagaacatggatgatttaaaaatctgttgttctttggaagatatccgggttgtgtttattttatttggagatgtctgttcgatccgtgagatcgtccaacagataaaagattccgggaaggttgcgatggttcatgtagacctgataagcggtcttagcagtaaggaaattgtcgtagattttattcggaaaaatacagaagcagatggaataatttccacaaaagccgcattgattaaaagggggaaggaacttaagctgttcacagtcctaaggtattttcttctggattcaatggcatatgagaatatcaggcagcaacaacacgccgtgaagcccgattatatcgaagtacttccgggtgtgatgccgaaggtgatcggaaaagtctgtaaaatgtcaaagacaccgatcattgcaggtggtctgatctcggacaaagaatctgtgatggcggcactttcagctggagcgatcgcagtttcatctacgaatcatgaagtctggaaaatgtaaaacaaaagtaacagaagatatttaaacaaagtacaggtatttgaggatgagtaagtagcgaagcggcatagaatatccgctttactataaaacatgcaaagcagcgatttttattaaaggaggaaaaagagtatggctaagtatgtaatggcactggacgcaggaacaacaagtaacagatgtatcctgttcaatgaaaaaggagaaatgtgcagcgttgcacagagggaattcacacagtatttcccgaaaccgggctgggttgaacatgatgcagatgagatctgggcaagtatgcttggtgtagccgttgaagcaatgaacatgattggggcagaagcagaggacattgcagcaatcggtattacaaaccagagagagacaaccatcgtctgggacaaagagacaggagagccgatccatcatgcaatcgtatggcagtgccgcagaacttctgagtattgtgacagtctgaaggaaaaaggacttaccgataaattcagagaaaaaacaggacttgttatcgacgcgtatttttcaggaacaaaggtaaaatggcttcttgataatgtgccgggagcaagagagagagcagaaaagggagaattattattcggtacagttgagacatggctgatctggaaactgacaaaaggtgcagttcatgtaactgattattcaaatgcttcccgtacgatgctgttcaatatcaatacgcttgaatgggatgatgagatccttgcagagctgaacattccgaaatgcatgcttccagaaccaaaaccgtcaagctgtgtatatggagaagcagatccttcttacctcggtggaccgattccgatcgcaggagcagcaggagaccagcagtccgcactgtttggacagacatgcttcaatgcaggcgaagcaaagaatacatatggaaccggatgtttcatgctgatgaataccggtgagaaaccgattttctcaaagaacggactggtaacaaccatcgcatggggactggatggaaaagtaaattatgcactggaaggttcaatttttgtggcaggagctgcaatccagtggctgagagatgaacttcgtattattgattccgcaccggattcagaatacatggctaagaaagtaaaagatacaaacggatgctatgtagtacctgcatttaccggacttggagcaccgcactgggatcagtatgcaagaggaacgatcgtaggaattacacgtggcgttaataaatatcacattatccgcgcaactctggaatcccttgcttatcaggtaaatgatgttctggaagcaatgaaagctgactctggaattgaacttgcagcacttaaggttgacggtggagcaagtgcaaatgattttctgatgcagacacagtctgacatcatcaatgcaccggttaaccgtccgcagtgtgtagagacaaccgcaatgggagctgcttatcttgcaggtcttgcagttggatactgggcaagtaaagaggatgttattaagaactgggcaattgataagacattcgagccaaagattgcagatgaagaaagagaaaaacggatcaaaggctggaataaggctgtcaaatatgcttacggatgggcaaaagaagattagattttgacagtaaaaaggaaatgaaaacagaacattgaatagggaaaagggggacttatcatgttaccttatatagcagagtttcttggaacaatgatacttattattcttggagatggagtagtagcaaatgtgaaccttaacaaatccggtatgaaaggtgccggtgcggttcagattacatttgcctggggtcttgcagttctgcttccggcatttattttcggagaggcttcaggagcttcctttaatccggcacttacgatcgcgcttgcagtggacggaagttttgcatggtcgatggttcctggatatatcattgcccagatcgcaggagcattcgtaggcggctgtatcgtttatttacttttcaaaggacagtttgacgccacagaagatccgggaacaaagcttggtgtattctgtacaggaccttcgattgcaaacacaggactgaatattttcagtgaggcagttggaacatttatccttgtatttgcaatcaagggaattggaaacgtgacaggactttccacaggcgttgacaaattatttgtattcggaattatcgtatcagtaggtatgtcacttggcggactgaccggttatgcgatcaacccggcaagagatcttggaccaagacttgcacacgcagtacttccaattaaaggaaaaggtgattcaaacttcggatacggtctggttgtaccgatcatcggaccaatcatcggagcaattgcagcagtattactgtatggggcaattccgtggtaaaagttcagaattgaaaatggtaatggcatgagatgagagagcctgacaggataaccgcataaaggaaatgcgtttacttggcaggctctttttcataatcaggaagttcaggaagaaaaaacagttattaaggagtgatctgggaatgtatgatgtaataattatcggagctggagtatccggtgcggcaacagcaagagagctgtcacgttataaagtgaaggcatgtgtaatcgagaaagaagaggatgtatgctgtggtacttccaaggcaaacagtgcaattgtccatgccggttatgatgcggcagaaggatcgctgatggcaaaactgaatgtcaggggaaatcagatgatggaacagctttcaaaggatctggatttcccatttaagaaaaatggctctctggttgtatgtctgcatgaggaggatatgccgaatcttcaggcactgtatgaccgaggtgttgcaaatggtgttaaggagttaagaattcttaactgtaaggaattgaaagaaatggaaccgaatatttctgatcaggcgtatgccgcactttatgcaccgacagccggaattgtatgtccgtttaatctgaacattgcaatggctgagaatgcaaatgtaaatggtgtggagttcaaatttgatacggaagttacggatcttaaaccaatagatgagggatgggagatccatacaaataacggagttttccagacaaggtacgtggtaaatgcagccggagtctatgcagacaagtttcataatatggtaagtgagaagaagatccatattacccctagaagaggagattactgcctgcttgataagagtgcgggaagtcatgtgagcaagacgatttttgcacttccgggaaaatatggaaaaggtattctggttgcaccgacagttcacggtaatctgatccttggaccaacggcgatcgatatcgaagataaagaaggaaccaatacaacaagagaaggtctggatcaggtgatcgaaagagcagagatgaatgtgaaaaatattccgctccgtcaggtgattacttcatttgccggacttcgtgcacatgaggacggacatgagttcttgatcggggaagtggaggatgcaaaaggatttatcgactgtgcaggcattgaatcaccgggacttaccagtgcaccggcaatcggagaaatggtggcacagatcctgaaagagaaaatgaatctggaagaaaaagaagattttatcgcaacaagaaagggcgttctggatccgaatacactcagcaaggaagaaagaatggaactgatcaaagagaaaccggaatacggaaatattatctgccgctgtgaaatggttacagagggtgagatcatggatgcgatcaacagaccgctcggcgccaaatctctggacggggtaaaacgcagaacaagagccggaatgggacgatgtcaggctggattctgttcaccgagaacgatggagatcctggcgagagaacgccatgtgagtatgttcgagatcacaaaatccggtggagattctaaaattgtcacaggtactaataaggattcgttataagagggaggcattgcatcatgagagcttatgatattgttatcattggaggaggaccggcaggacttgcggctgcaatttcggcgaagaaaagcggagtggacagtgtcctgatcctggaaagagacaaagaacttggcggaatcctgaatcagtgcatccacaacggattcggactccatacatttaaggaagaactgaccggaccggaatacgcaggacgttttattgatcaggcgaaagaactgaatatagaatacaagctgaatacaatggttatggatatcagcccacagaaggttgtcaccgcaatgaaccgcgaggaaggtcttttcgagattcaggcgaaggcagttgttctggcaatgggatgccgtgagcgttccagaggtgcacttaatattccgggttatcgtccggcgggtattttctctgcaggtacggcacagagactggtcaatatcgaaggctatatgccggggcgggaggttgtgatccttggttccggcgacatcggactgatcatggcgagacgaatgacatttgaaggcgcaaaggttaaggttgttgcagagctgatgccgtattccggagggcttaagagaaatattgtacagtgtctggatgattatgatattccgctgaagttgagccatactgttgtggacatcaaagggaaagagcggctggaaggaattacactggcacaggtggacagtcacggaaaaccaattccgggaactgaagaagaatacagctgtgatacgcttcttctttccgtaggattgatcccggaaaatgaaatttcaagaggcatgggcgtggatatgaaccctgtcacatcaggaccaaaggtaaatgagagcctggaaacaaacatcgaaggtgtatttgcctgcggaaatgtcctgcatgtgcatgacctggttgactttgtatcggaagaagccggaactgcaggaagaaatgctgcggaatacgtcaaactgggagaagagcgcagacaggacggaaaagagattcggatgaatccgattgaaggtgtccgctatactgtgcccggaacaattaacgtagaccggatggatgaaaatctgactgtgcgtttccgtgtgggcggtgtctacaagaactgttatatcagtgcatattttgatgatgagagagtgatccacagaaaacgtccggttgttgcaccaggtgagatggaagagattaagctgacaaaagagcagcttctgaaatatccggatctgcagaccatcacagtaaagattgaggaggcgtagacgatggaagagagaaaattgacatgtatcggctgtccgatgggctgccctcttacagttgtaatgaatgggaaagaagtagtgggtgtaaccggaaatacatgcaagcgcggtgatgtatacgcaagaaaagaagtgacaaatccgacgagaatcgtaacctcgaccgtgcgggtgtccggcggaagcatcgatatggtatcggtgaagacgaaagaagatatcccgaagggcaagatctttgaatgtgtgaaggcgctcaaagaaattgaagttccggctccggttcatattggggatgtgattcttgaaaatgtggcggacacgggcgtggatattgttgcgacgaagaatgttgaataaaaggaaaagaaggagaagtcctgtatggtgacggaaagggttgccatatgggacttttttaatgtgaaagactgtgacttttgtttgaaattatgcagaatacttaacaaacttaaaaaaattacacattttttggaagaaatttataaaaccaaaaaattttatacattcacataaaaaatgaatatagtgaaaaaacaggcgccattctaaaatattcacataacaaagaatcgtttgaaatgaacgacaggagaatatgaaagtttaagggaggaacgagaaatgaaaaaagcaaaatgctttagtgacatccattacgacattggaaaaattgatgacaaaatgtactcgtcttttacagaacatctgggacgaagcatttatacaggaatctacgagccggggcatccaaatgcagatgaagacggatatcgtaaagatgtcatggaattagtaaaagaattaggcgttccggtaattcgttatccaggtggaaactttgtatcatgctatgactggcatgatggaattggaccaaaagaaaaaagaccaaaacgtatggattatgcatggtcaagtattgaaacaaaccagttcggtattgatgaattttgccagtgggcagaaaaagttggtattgaaccgatgatcgcagtcaaccttggaacaggaagtattaaagatgccggcgatctggttgaatattgcaatcatccgggtggaacctattggagtgatttgagagcccagaacggacatccagaaccatataatatcaaatattggtgccttgggaatgagatggaaggaagctggcaggcaggacatttgtcagcagaagattatacaaagaaagcacttgaagcagcaaagatcatgagatgggttgatccttctattaaactggttgcctgcggaagcagttatgaaatgttaccaacctatatggaatgggacagaacaatgctgacagatctttataatcaggttgattatttatcaactcataactatacaatgaactctgggcagggtacaacaaattatcttgcttcctataaacagctggattctcatattaaaaacagcgcaaaagttattgagtatgtaaaggctaaaaatcattttgataaagatttaaagatttgtctggatgaatggaatgtgtggaatttccaggacatcaaactggattctctggatgatttaatgggacttacaacgttcgagatgacatcagctggaaaatgggaaatcgcaccaccgattctgcaggaaaaatacagtctgctggacgcagttgttgttggaggacttggaatttcattgttgaacaatgcagatacagttgaaattgcatgcctggcacagcttatcaatgtgattgctccgattacaacaattccgggaggcggaattttcaaacaggcgatttatcatccgttccatatgctcagcaaatatggacatggaactgttaagaaagccattgtggatgcaccgaaatatcagtgcgatttaggtgaattaaatgttgttgaaccagcagttatctataatgaggaaaatgatgaagtaagaatcttcgttctgaactgcgatcaggaagaggacgttgaatttgaagttgatttacagggatatggagataagaaagtaaagaaacatctggtacttgccggaaatgactattctgtaatgaacacaattgaacatccggatgcagttgaaatggaagagaaagaggtaacagctgcaaattctgtagtattaccaaaaatgtcatggaatgtaattgttttaggataataaaagaagaaggaaagagggaggtggcaacgaaatgagcgtgattttggaagcaaaacatatttcaaaaaactttggacttactcaggcattgaaagacgtttctgtaaccattgatgaaggagaagttattggtctgatcggagaaaatggttccggaaagtcaactctttcctctattatttccggagtttatccgcaatctgaaggagagcttactctggacggaaaaccatataaaccagcagacacactggatgcacagaatcatggaatcagtatgattgcccaggaaatgggaacacttccgggaattaaagtagcagataatctttttatcggaaaagagcagttgtttacaaaacatggtgttgttgacagaaaaaagatgtatcaggaagcaagaaaggcacttgaaaaaatcggaattgacaatattcatccggaagatccgatcataaaatacagtctggaagaaagaaaactgattgaagttgtaagagcactgtatacgaatccaaggattttcatcgttgacgaaacaacaactgccttgtctcaacgaggaagggatatcatttaccaggttattaagaacatgaagaaggaaaataagacagtactgtttatttcccatgacctggaagaactgatggaggtttgtagcaagctgattgttttgcgagacggtgtgtttgttgctgaacttgaaaaatctgagtttgaagaggaaaagataaaagagttgatggtaggacgtaaacttaccggagattattatcgaagtgattacgatggaagctatgggaaagaggttgtgctttcagcagaaaaactgtatgtaggagatagccttaaaggtgtctcactggaacttcataaaggagaaatccttggaataggtgggttaacagactgcggaatgcatgaacttggaaaagcgttatttggaaatgttaaaccgttgtatggtgaagtaaaacttggaaatggaaaaaagattacatcagaaaaacaggcaatcaagaacaagattggatatgtatccaagaatcgagaccaggaagcactgatcttatcagcaagtatcatggaaaataccgttttaccatccttgtcaatgatcgcaaaaggtggtgtaattaccaaaggtgctgaaaagaaatttaccgataaacaggtaaaagatatgagcattaaatgcagagagattggacaaaacgtaggtgatttaagtggtggtaataaacagaaagttgtatttggaaaatggcttggtaatgagtcagaaatttatatcctggactgcccgacacgaggaattgatattggtgtaaaggcatttatgtatcagctgatgtaccgcctgaaaaaagaaggaaaatctattttgatgatttcagaagaacttccggaactgattggaatgagtgaccgtattctgattatgaaagatggtcagatacaggattcatttaccaggtcagaagagttaaatgaatctgtattaatcaagaagatggtttaggagggataaaagtgaaagagaaagctaaggcaaaagaaattcttcagaaaataattcctttccttggaatcattttaatgattatcatatttcaggtcggaggagaagggaaactgctgacaaaaggtaatatcaatagtattctgaatcagaccgtatatattgcgattatggcatttggtgcaattttcgtatactcacatggcggaatggatttgtcatacggtggtgttatcggtttcagcgttttagttgcgattttagttgcgaacacaggagtaccggcaggagtagtatttattacaaacattcttgcagcactggtatggttcgtattgaacggagttgtttccgtatatttgcaggtttcgccatttatcacatcactatgcatcatgtatatgtgtcgtggaatcttaaatacggtatgtgcatcacagaaatatagtattccggttgaactctttgaatttgataatcagaaatttaagctgggaatgctgttaggagtctttattatctgctatattttatttgaaaaaacagcaattggaaaagataataaagcaattggaggaaatccagccgctgcaaagcaggcaggcgtaaacgttaatagaaccagaatgatcgcttacattatcagtggtatcacggtaggtattgcaggatttatccttatggcaagagccggaagtgtaagtacttcaactggtcagggaatggaaatgaacgttgtcacagcattggtacttggaggtgtgccattgtccggaggttctaaagtaaaaatgatcggagctgtggtcggaagcttttctgttatccttttgagaaatggattgattatcctgggtgttaacgaacgtgtggttgaaggaattcagggactggtactgttactgttagtattccttacatatgtaaagaacaaagatggtgtactggagtaatagatgaaacaaggagaaaaagaggaggaaaagaaatgaaaagaattaaacgagcagtagctgttttattagcagttatgatggtattctctgtaatcggttgtggtggttcttcaggaagcaagaaatcagacagcagttcaaaagagacaaaagatgcaaagacagaggaagtctggggagacaaatcaggtcaggatgaaatttgtggagatccggatggtaaatacacaattggtgtagttatccatacaacaacagatttcctttgcgcaaaatacaaagcatacacagattatcttggaaaagcatatggtgtaaaatttaactattacattattgaaaactttgcagatgaaacatatctttctgcaattgaaaacctctgtgcacagggtgttgatggtattatcacaacaaacttctcaggaacagcagtccttcagggattaaaaatttgtgaagaaaatgaagtttatcttggtgtaggctggtcacagattgatgaaagcatcaaagatcaggtttacaagagtgattactttgttggtggatcttatgaagcagattacgatgcaggatatgaaatcgtaacaagccttattgattcaggatgcaagaacattgcagcaattggctatgaacctggaattacctgccatgacagaagatgggaaggtatgatgaaagcatttgaagatcatccggaagttaaaaaagctggtgaatacagaggccttgaattcacaaaagcagtagaagatttccttgcagcagatgattctatcgatggtattgcaattacacttcttggtattgaatactgctcagaaccaatcaaatcagcaggacgtgaaggtcaggttaagatcgcattctgtgacctttcagaaaactgtcagggaagccttgacaatggtgaaacagtatgtgcaatcggtggacagtatgctgatgcagtattcccgttcgtacttatctacaatgcactggaaggaaatgctcttgacaaagtagaagtaccggttaactttattgtatgtaaatctggtcaggaattctctgattatatgacataccttcataatgatggtgtatatgcatggacaacagatgaagttgatcagctgattaaatcaaaaaataaaaatgcatcttctgatgagctgcttgaaatgggcaagaactacagtattgaagatacaattgcaagacatggaaaataaattactactttaacggatatggaaagggaaggcgtatgaaaacgaaatcagatacagttaaaaatgtatgcaaagtcgttatgctcccggtatttgtatatcttctgtttttcatatgctccggcggagcatttggaaaaccggcgagtcttattatgaacctgaagcaaacgctggcccctacgctaatttcattcgcaatgtgttcgaacatgttgtgtaacagaatggatcttagtgcaggtgcggttgtaatgctctcggcaatgttcggagcaaaaatggtatatctttacggaatcggattgataccatttgcattgattgtggttggagcgggcattgtacttggaacaatctcaggtgttatgtatatgttactgagagttccggcaattgttacagcacttggtgtttgcatggtatatgagacattatccaacctggcaagtatttcatgggtaacagctattaacggagaaattacaacacttggaagatttccgtattgtttgattatttttgcgatcatgtttgtactgttctacatcattttcaactatacaaagtttggatataatgtaagagcatgtgcaagttcacagagaattgcaaaaaattcaggtgtcaataccaagaaaacagcattcctctgctatgtagtttcatcattattccttggagttgcggcacttttgaagatttctatacagggatcaattgatacgccgatgtacatgtcaagtacgaatattattttcaactgcatgcttggaatttatgttggactggcacttgaacagtattgtaatctggtaatcggaatctttatcggaaactttattttaaatatgctgacgacaggacttctcagcatgggactttcagcttcgctgcaggatacagcatctggaatcttccttctggttattatgatctttacttacaacaaccagagagtaatgaactttatcagtgaacgaaagctgaaaaaagagcttgtgagaacaaacgcacaataaaaaataatttaaatgacacccggagtatacgcatcctgtcagcttgcgatactccgggtgtcgctgtataatcggaatagacagcatttgacagggcataatgggaggaagaaaatatgataaaagtattgttagtggatgatgaaaagctggcactggagtatttggagcatattattgattgggagtatcatggatttgaattgatcggggtaacgacaaatccagaacaggcacttgcaatttacaagacacatagaccggatctggtgatatcagatgtaaagatgcctggattaaatggattggaattaggggatgcaattcgcgaatatggtggaaatacacatattctgttcctttcagcatataaaaattttgattatgtaaaacaggcaatccggttaggaattgatgattatatcttaaaaagtgatctggaggaagatgggtttttaagaaaaatactaaaattaaaagaagaaattataaaagaaaaagcaaaaaagcagtatacaattacagcaattttagaggaattatttagaaaaaatatttcagaagaggtatataaagatattcttgatgaaaatgattatataggtttgcataagaaatattattatattatcgtttctcaaagaaaggttccgaagattttaaagaaatatattccacttgataacaatcagatgacattggataatcggctcataaaaagagcgtgcgaaaatgtatctgaaaatactgggattcatgtaggggccaggtttccggtaaacgaagatgaatatctgattttgcttgaattcggaaaaggaattgtttcacaaaaagaaataaatgacagaatttatgattttgcaagaaagctgtatgaatatattaacagagaagaaaaactgtatcatgtatattattgtttgcatggaagtatggtaaggcagttccggtctaattttacaaattatcaaagacaactggaaaataatattttaaaaaatgaagtagagttacaggagctgcgttatgacggaaaagaggaaaatgagaagaaactgtcaggaatttcatcagaagaaatttatcagtctttacaacagggaaaaacagaagaaattgaaaaaatagaaaaccgattgcatgaaacagaaaaaaaacagaatgttacagaatacttggaatatatagaacatattttggaggctcttagtttgtttgatggaaaactgattggagaaacaagcggtcagagatttttgatgaccgagggatgcagttcttatgattttagaaaagtaacagatcttcaggcatatattgaatacaagatagaagaaatttgtcgaatgaaaaatgagaaagaaaaaatgatttattccgatgtgacaatcaatgcaatggcttatatcaatcagaattatggtgatgcaagtattacagcagcggaagttgcggagcatgttggtgtgacatcttcctggttatcaacgaaatttaaaacagaaactggaatacgggtaaatgattttatcaataatgtcagaatagaaaatgcaaagaaaatgttccaggataaagaatatatggtttatgaagtatcagaaaagacaggttttacttccagtcagtatttcagtaaaattttcaaagaatatacaggactgacaccgaaccaatatcgcaggaaattattagccggagagtagaagaggtcatgaaattaagaaataaattggttatagcacaattatgtgtgtttttagtaattatgggaatattgctcacggcattaccggaactggtatatagaaatatcagtgtgaaagacagagaggatactatgattctgaatgagcagatcatgtctcagttagatcagaattttgaagaactggtaagatttacaaagattgtggcagaagaaccagaacttattcagaaaatagatcaatatatgtcggagccgaatgaagcaaataatgcgaaaataagtctttttttatcccagcttggtgtaaaaaataaaattcagtcatatggaatcatcgggatttatctggatgtccaaaaggcggatgaaatatatgatttttcaacagtaggattttcgaataaagtaaaagaacatatttgtagtgaaataaaagaattagatttaaaagggaaaaagacaagttttttgaatccttttgcttatgacggggaatcagatacagcatttggaaatatatttaacatggtttatggatatacgatggaatatatatatcatgggcagaaaggcaatcttactgttatagcatcttttgaccagttgtactatattgcaaaccagatgaaagattacagtaacgattatctgtttcttgataaaaataatcagattttacagccaagtgttaaggaaacacaaatagatgtaaatgcaactctgaaaaacatgaagtatggaaaaagctataaggaaggttattggcagcaggaagatgggattactacagtacgtttttcagaagaagatgggtggaagattatttgcaggcagagcagaaaagatattctggacaataaccgttcgctgatttttctggtagaaatactgattttatgttttgggcttggaattgtgttagttatgattccgattgtaaatcattttaccggtccgcttacggatgtatcaaaacaaatgaatgaaatagcagaaggaaatctggatgcacgaatcgaggtgaattcaacagatgaaataggagaagtaggcgcttcgtttaatgttatggcaaaacgtttgcaggaaaatattgttgaaatggtcgaacaggaaaagagagagcagcaactgaagtatggtctgatgatttcgcaggtggatccacattttatttataatacaatgaatatgattacatatctggcacagaaaaaccggaatgaagatgtgattgcagtgaataaagctatgattcagattttaagggacagactacgtatagaggtggataatgtttatgatacagtagagcaggaaattaaagtagtgagagaatatttactgattcagaaatatcgatatacaggaatatttaaaagtgttattgatatcgaagcgggggttgagccatatctgattgcaaaaaatattttgcagccacttgtagagaatgcgttctttcatggaattctatgtaatacggatgaagaaggcgaagtaatagacggatgcattacgattcgtatcagaatggaagaagatgaagttgagattattgtaaaagataatggtgcagggatgtctcaggacaaactagatgaattaagcaaaccgcagcgtaaactgtcaagtatggaaagaggagaacatatcggtataaaaaatattaaagaaagactggactatatttatgaaaataaatacagatttcagatatggtcaaaagagggcgaaggtacgatcgttacgatccggattccggcaattgtatcaagtgaaactgagaaataaaagaatggaagaggttctatgtagcagtaaaaactgttatatggagcctttttatataagtaatgaagggaatttatgtgtctgaaagaagcggaaaagggccaacattttgtgatttcgttaagaaacgggtataaacattttctattttcgttaaaaactagcgtaaaacatttctgtttttcgttaaaaagcaaggaaaaacatttcgtgttttcgtgaaaaaatgtataataggagaatcgaaacattgcgcaggaggactttcatggaaccattctattataccaaaatgacgaaacagcagcaggcagcataccatgtaatcatgcagggagcgaatgcacttgcggatgaatttcagataccgcgcatagaaagtgcggagctttatgatgtctttttcaggcttcggctggatcatccggagattttctggatgacaggatataagtataaatactatcaggactctccgaatctgatctttgtaccggagtacctgtttgacaaaaataaaatccgggagcatcagagggcaatgtcctccagagtagaaaaacttgcgcgggcggcaaaagatttgtctgaatgggaaaaggagaaatatattcatgattttatctgtgataatgtgacttatgataagctgaaaaaggcgtattcccatgagatcatcggtccacttggacatggagttggcgtatgtgaagggattgcaaaatctgtgaaagtactctgtgatgcgcttggaatctggtgcatgatcgcagtctgtggtaacaatccggaaaaagggatcaagtaccgtcatacttggaatatcgtaaaaattggtggtacatattatcatctggatgcaacttttgacaatacgcttggtaaacacagtgcggcaggacaggagatccgctatgattatttcaatctggacgacaagaagattttccgggatcatgaaccgctgatcgcaccggcaccggtctgtacgaatggggatcatttttattatcgggagaagaaactttcctttacaaaagaagaagatgtctataaacggtcgctgcaggcggctaagaagggcaggatattgacctttcagtggagaggcggctatctgacaagagaagttttggagaaacttttggatctgctccggaaagccggagaagagaagcagaaggctgccaggatcagcctcaactggtcgcaggcagtgatccgtgtcagttatgtggaggacagaggacttgcctgtgtggatatggaagaggcaaatgaaggagaaaaggaatagatgagtgaactggaaatacaggaaaatatgtcagcagaggaagcgttcatggatacagaaaatgcatatgaagaaattccggaggccttccagaaacttgcccagttactcggtcaggatcagtttgaagttctgtttccagataaagatgccaaaaatcaggatgagatccgcttggtgtatctgatgaatgatgcagcggaaagctttctggtttttatcggtgcgaggatgaccggacattatcagaaggattatgaaggagagctggacgcaactttaagccaggaggatggagaatatgtacttgtcgtatatcagggcgaaacggttgtgaccattttcttccgggaacttcagttggaggtgaacctttataattacggagatgtgggacatttctgggtgaaagggtatgagtatctgcggattctggaatatcgtctggcgattctgagtgataaatgtgaatatcttggagaaaaggcaacaagtgatacagaacggaaacttgcaaaactggtacattttcctccgctgaactatacctgttatccggcagttccggcaaaatatattgtcccgatggaagatccgtggaatccgaccgaagaggcaatggatgtaatggaagagctcgttaaagaagcaggggacaaaagtctgttgtggtggctgcaaagataccggagatatcatggaaaaagaatgagcagatggattgcccgactattacatcgggagaaacatgcggcggttgtagacttgctaaataaaaaacttgccaaagaagcggaaaattatccacggagggattttggggagaaatttaatcagaaatatcagaacattttgaaaaaagccgaaaaaagaaaagcagagctggagtcaaatggacagaaagttacacttgtacgtgaggagccatttgctgcggcgagagattcggtagatttcaaagtgtacctgatgatttggaaagaaaagcagggggaccgtgttgctgaaatagaagaattttagcaatggatgatatgagaacttagaaaatagaaacaggtcaacggagtgaaactcaattgatattcaaagagaggaacaaatacaaatgatcaaccgagaagatatgctggaattgacgcggcggatgacgcctgcaagaacatcattcacaagaatagcaggctgttatgtagatgcagacggagattttgacggaagctttaatatcaacttcctaaaactctctgcgtcagaaaaaacaaaaaatctcgcaatcgccaaaacgattccatttgcagagacaaacagaaaactgaaaaaatacgagatccagccggaaaatcagaaagccggaagtatgtggcagcttttgatggcgctcagagactgtgaactcaaaaacgatgccctgatggatactctttatgatatcatcatggaaaacatccggatcaccaccccttacgcgatctatgttttccatgataactacgatatcccagccaaagccaccgataaagaacgcctcggagaatccgaagagatgtttccttacctcatctgcgccatctgtcctcttgtcggcgaatacgaacccggatccccaacatccggcttcctcttccccgcctttacagaccgcagcggtgacctgaaccacataaatatctatggcataactgaaaagaaacgtgaagaacttggtagacttatatctttataataatgtgttgttggaaatattttaaagatacaaatttttaaaaactaaaacaaatcattatactcaaatttatgaatatggttaaaaccctagacaaacaaatcaccattagccatgcgcagcgagctgatgttccataagggaaaattttcaagttgcaggagtaccagaaaaaacggataaataaatgaatcgggtcagattcccttgagcactatggagatgagactcagtatattgtggaagccattgctgacacaatatacgctttcagaggctcatcggaatgcccagtgcgtgggaagcatacccgattcatttatttatccgttttttcgtccccctccaacaccttaaaacctaccttattcatccatcagcaagctccggaactccgtaaagaaacgtccctgctcttctttggtcatcttaaccagcatctccaggctttccatactgatccgcccggctgagaacagcagttccgtataatcccatttcgtatatccatactctttttcccagtcgcagattttcttcattccataataatagcatgtgaaatatcccggcgcattctggtgtgcctgtacctgggcgcgggcagttacgcggtcaaagccaagctcttcttcgtagatttttacagcatcttccagtgtcgctccaaaataatacagctgcagatcaaccaggatacggacagaggcatgatgacggcggaatgcaacgaacagagggaagaacgggtcttccgcaaagataaaggtaaatgcgcgttcagtacgaatacaggttccctcttccagaggtacactttttgctcctatttttacagtttccggtgttggatcgatcgctgcgcggataaactggacatggtgtcccggataagtttcgtgcatggtattcatcttgatccagccatcggtaatgttctgataattatactgattcaggaacatctggccgcggagcggtttgacacggaaatcaccaccctcataacctccccaagggtaagaatccttatagcaaggcggaagcggaacgcacagacaggtttcatcttccggaagacgtacatattcatgagcgacagcacgggtacgtttcagataatttctggcacgtgtatacatttcctcggcactgtcacaaggaccggcatagcggaaaagcacatcgctgacttctttcattgtcttcggagttccttccggaagctctaatttggaggcgatttcgaatacttcagcacgggtcttttcaatttcttctttatgccatgcaagcagttcgtcgagagatacaccaagacggtttttcagaaggctgcggtaagcttccggatccatcttgatggtctttgagagatcatcctttaacaattcttcagagtcagactggcagtcagaaacgagtaaatctgccatttcctgaagctgatcgataaaaatccggaaggactgtgataaagatgcaatctgttcttctgtgaaatccgggaaatattcatttaacagtttcaggtcgcgctgcatatccagccttgcgcgggcaaaggcagaagaaagggaagcttcattttctccgtattgtgtgtggatcagattaaggatcaaatcctgattttcatgaaatgcctgtaattttctggtcaggacatcgagacgtacttcattagaacgctggtcacagcgagcgatttcctgaagataatagacaaaatccaggagaggtgcttccggattgtgttctttttcttcgatagtaaatttaagagaatccaggaagtcattcagatgatgcttcaccagacgatagacattgtcaggtgtatccaggttttcaacctgtgtttttaaatcgttccatttttcgcggaccgatctgatcttttcgggagtcgggagaaaaaggatattttcaaaagaacggtggctttcgagttggtcatgcaaaatggcaagttctctgtcaagttcgcggtaagtattggttaagtcagtatttttcatgagtaaatggcactctccttttttagaaatttgttctgattgtatcttaccgcagaaaatgtcaaatgaaaagcaggacagataaaaagattcgcgtgtcgacttatgcccctttctgtgatatgataatcaagagattattatgagcagaaaggggcattttttcgatggcagcaacatctgaaaataagccaaaacaatatatatctgtcgggatcctggcgcatgtggatgccggaaagacgacactttcggaaggaatcctttatcttaccggtcagatcaggaagcttggaagagttgaccatggagatgcgtttctggacacgtatacactggagagaagccgggggattaccattttttccaagcaggcgaattttgtgcttggagacaagcaggtgactcttcttgatacaccggggcatgtggacttttcagcagaaatggagcgtaccttgcaggttcttgattatgcaatcctggttgtcagcggagcggatggtgtgcagggacatacacgaaccctgtggaatcttcttgcaaggtatcaggttccgacctttatttttataaataagatggatcaggacggtacggacagacaggacagacttactgaattaaagcggaagctcagcggagagtgtatggattttacagaagcgggtgaagaatttctggaagagctgtctatgtgcgacgagacagtaatggaaagctatctggaaaatggagagatcacggcgagccagattcagacgctgatccgggaacgaaaggtatttccatgctatttcggttcggcactgaagctggaaggtgtgcaggaattactggacggactgggaaaatacatggacggatcggtaagcgggacgcatgcggaagaagcatttggagcgaaggtatataagatatccagagattcacagggcagccgtctgacacatgtgaagattacaaacggagtactgaaggttaaagagatcctggaatatatggcagaggaagaacctatgcaggagaaagttaaccagatccggatttattccggggacaagtacgagatggtgcaggaagcagaaaaaggctgtatctgtgctgtgacaggacttacccggacttatccgggacaggggcttgggatgcagaaaggttcttcggcaccggtactggagccggttctgaattaccgggtagagctgccggaaggctgtgatgtacaccggatgctgcagaatttcaggcaactggaggaagaagatccgatgctccgtgtagtctggaatgaagaggcaggagagatccaggtccagctgatgggcgaagtgcagacggagattctgcaaggccttgtaaaagaacggtttgacgtggatatttcctttggaagcgggaatattgtttacaaagaaacgattaaaaatacagttgaaggagtagggcattttgagccactgcgtcattatgcggaagtgcatctgatactggaaccgggagagccgggaagtggaatctcgatcgatacgatctgcagtgaggatgtgctggacaagaactggcagcgactgatcctgacgcatgtgctggaaagagagcatcggggcgttctgacgggatcgatgcttactgatgtgaagatcacacttgccagtggacgtgcacatctgaagcatacagagggcggagatttccgccaggctgtgtaccgtgcaatccgccagggactgatgcaggcagagaatgtactgcttgaaccgtattatgcatttcgtctggaaattccgtcagagatgacaggccgtgcacttacggatattcagcggatgaatggagaatttgacggaccggagacggaagatgatatggctgtggtcaccggaagtgcaccggtgtctgaaatgcaggattatcagagagaagtaaccacatacagcagaggaagagggaaactgttctgtacgctgaagggatattttccatgccataaccaggacgaggttgtagaggcgattggttacgatccggagcgggatgtggagaatccgacgggctctgtattctgtgctcatggagcgggatataatgtaccgtggcaggaagtgccggaacatatgcatattgaggcacagcttccgaagatcctggaagagcggaaaaggctggcaggagagacagaaaaaagtctggatgagactgtaccggtaaatttacgcaaggagaaaagcggatcagcagaagcagcagccagaggcggcaggcattatgcgcgtaatgccagagaagacagggaactggaagagatttttatccggacttacggacgggtagagagaaaagccgatcgtcttccaaagactgtgactgcagggaaaacgccaaaagcaaagaaagatgaagaaggcgtacaggaatatttgctggtagatggttataatgttattttcgcatgggatgatctgaaagaactggcaaaagagaatattgaagcagcaagaaataaactgatggatgtgctttgcaattatcaggggttcaagaactatcctctgatcctggtatttgatgcctacaaggttgaaggcgaagcaatggaaatcttcaaataccacaacattcatgttgtgtatacaaaagaagctgagacggcggatatgtacattgaaaaggtagtacatgaagtcggaagaaagtatcatgtgacggtagttacatcagatggtgtggaacaggtgatcacacagggacagggaggtacgatcatatcttcccgggagttcctggaagaggtgaagatcgtgaaccggcagattcaggaagaatgggagctacacaaagagagtgcgaaaaattatctgttcgatcatatggacagagagcttgccggtcatatggaagaggtccgcatgggccggaaagaattgggtgagaaagcaaatgatcaataaagaggaatttctgaaaacctgtaatctgacagaggatgaccttacggctgcccggatttcctgggaggagctgacagagatctatgaagattatatgtcaaaaacgaaattgttccgtcatctgggaaaagaatttgtagatgaatatatttatgatattgagcgggcagggatccattcctaccgttacagaaccaagaatccgatgcaccttctggaaaaaatcatccggaagcggaaagaaaattatgcaaaatttgaacatatcaacaaatcgaattaccacaaatacatcacagatttgattggtatcagggttttcttcctttaccgggaggactggatccattttcataagttcatcacttcgatgtttgaaaatgatccgaacaattatatagaggacaggctgcgggattttgatgaggatccggagcactgctatatcgcagaacgtccaaaagtatataagcgttccggggatacaaggatttatgacagtacgcagattgaagtgcggacaggcgggtattaccgttcactgcattatatcatcaagtatcacggatactatctggaaatccagggcagaacgctttttgaagaaggatggagcgagattgaccatgatattgtgtatccgtattacaaggatgatgagatgctgacggagttttccggactgctgaacagactttcgggaatggcagatgagatgagttcgtatttcagaaagatgaaagaactcagagaagaagaaccggataaaaaataaaggatctcttgtaaaaattaaaaatatcatatcactttatgggtggtatctttttgtgaactatgtgcggaaaggtacattcttttttgatattaaatgattggaaatttgtttataataatgagagcgtagggataaaaagaaaatacttgcgtataattagcctagattattcacggctatgccgtgtgaagtgcgtgtgaaaaaactcttgttttttcacacgcactttctttttttgacttttttcaaaatcatctgatattttctgcttttcaaaatgcgattagtgaaaatgcataaaaataaaactataaaattgttaaaaataaccaataagtacaaaacatgtccaaatttgacagtgagaaaggtctaaaatgacagaacaagatttaaaattcaagatagaatcatattgcaaacgaaaaagaaacgttaaaacaaagaaaaataatataaaagcgaaaggagaagcgtatgaaaacgcaatgtcatacccttcagatgcggaagtgatctattattccggagaaagtgcatcccattgcaggcggcttgcaaaagaggcagatgtggttgtgattgtagcgggaaatgattatctagatgaaggagaatgtgtggcaaatgaatcggcagatgtgacggttcagaatgagggcggcgacaggacagactgcctgggtttaaaagaggaacagctgagaattattgatgcagtcggaaaagtccggcaggatgcagtggtggttctggttggcggaagcatgatcctgatggatgagtgggaagatcaggtcggagcgatattgatggcgtactatccaggaatggaaggtggaaaggcagtcgcagatgtattattcgggaaaacgaatccgggtggaaaacttccatttgtgattccgaagaaagaagaagatctgccggagattgactgggatgcagaagagttccgatacgattactatcacggatatacacttctgaataaaaatcatgtggaaccgctttacccgtttggatatggactttcttatacaacatttacgcttaccggcatgaaggcgtggagagatgaagaaaatctgtatgcgtctgtgatcgcgaaaaatacagggaagcgggaaggcagcgaagtggtacagatgtatgtgggagcagctgattccaaagtagaaagaccggagtatgtgctcaaggattttcagaaaatacggctggatgccggagaagaaaaagaagtgaaactggtttgcccgattcgagagatggcatattttgatgagggtagaaatgaatttgtggcggaattttcaattccgtatgaagtgtatgtgggaacgagcagtttgagagaagatttgtgggtaaggaaagtttgaaaaagggatgtgcgggtttattgtactaattagtacaatagccctttttaaaactttttgccagaatgaaaaattgaatcataaatacctgtttccggtttaatattttaaaaataaatccaacatatagagaagtgggaagcgagcgttgcttacttcccacttcccggttataattggaataacagaaattaagtcagaaaggatggattcaatggaatatataacatctctacaggcagcagataaatggaatctttcaaaacgtcaggtaaatgcgctgtgcaaaagcggacaaatatatggtgcagtaaaaaaggacagcgttggatgataccggaggatgcaacttttgaaaaatatctcaatcattacgatgtgatttatctggatattaccttgtaggaattaattacaaaaaagcaacgaaagaacatacctgtaaaatagaagagattattctttaatcaggcatttatggaggaagaaaaccatgcgatttcttcatttatcagacctgcacctcggcaagcgtgtgaatgaattttccatgctggaggatcaggcatatattttaaaagagatactgaacattatcgatgagcagaaggtggaagcggttctgatcgcgggcgacatttacgacaaggtgattccgtccgcagaggcggtgaggcttctggatgatttcctgacaaggatcgccgcgagggagctgccggtgtttctgatcagtggaaaccatgattctgcagaaagaattgctttcggttcaagactgatgagcagcagacagatctatctttcaccggtatttgagtcggatgtagaaccagtaacgataagtgaccggtatggtgagatcaatatttacatgcttccatttgtgaagccgtctttggtaaaaagagtgtatccggaggaagaaatcatcacctatcaggatgctgtaaatgcggcagtgcagcatatgcagatcgacacagacaaacgaaatatcctgcttgcgcatcagttcgtgaccggtgcggcaagatgtgattcagaagaactgtctgtaggcggtgtggatgatgtggacgcatctgtttttgacggatttgattatgtggcgcttgggcatctccatggcccgcagaagatcgggaaagagacagtgcggtattcggggacgccgctcaaatattctttttctgaaaccaatcacaaaaaagcagcagtcattgttgatgtagaagaaaaaggcaaaataaatattcagcagattccatttttgccgaaacatgatatgcgggaagtcagaggcacgtatatggaagtgactgcgctggatttttacaaggatatgaacacggacgattatcttcacattacgctgactgatgaagaggatatcccggatgcgatcgggaagctacgatgcatttatccgaatatcatgaagctgtcttatgacaatctgcggacgagagcggcagggacagtgagaggaacggcagaagtagaggagaaatccccgatggagcttttaagagagttctatgagcttcagaacaaccagcccatgacggatgaacaggaagagattgccagaggaatgatggaagaaatatgggaggatgagagatgagaccgataaaacttacgatttctgcattcggaccgtatgcaaaagagacagagatcattctggatgaacttggtgagcgggggctttatctgataaccggcgataccggtgccggaaagaccacaatttttgatgcaatcgcatttgcactttacggggaagcgagtggaaatgaaagagagccggggatgcttcggagtaaatatgcggatccgaagacgccgacctttgtggaattggagttcttctatcaggggcagaactaccatatccggagaaatccggagtacatgcgtccaaaggacaggggcgagggcatgacgctgcaaagagcggatgcggtactggaatttccggatgacaggcttccggtcacaaaggcaaaagaggtcacgaaagcagtgacagaactgatcgggctcgaccgcggacaatttactcagattgcaatgctggcgcagggagattttatgaagcttttgttttcaaaaactgaggagcggagcaaaattttccgggaaattttccataccagaccgtatcttgcatttcaggagaaaatgaaaaatgcaagtggcagattgcaggaacagtacgaggatgtcagcaaaagcattttgcagtacatgaaggatatcagctgtgatgaggatgacgtgcttgctgcggatgcgaaaaagatccgtgagagcaaagcagtggttcatgcggacaaggttctggaacttttggaaactctgacaaatcaggatgcagattcggtgaaagaaaagaagaagaatttaacgaagatcgagaaagatctggaagagctgaaccagagaatcggaaaggcagaggcagtgatccgtgcaaaaaaggaactggaaaaagcggagcagacgatagcagagaagacaccaacgctggaagaactggaaatggcactgaagaaagaacagggaaaagtgccggaaagagaacagctaacagaagagatcggaaagaggcaggaaaagcttgcaaagtatgacgaattgaaaaaacttcagaagcagattaaagagcttgaaaaacagattgagatattaaagggccgggaaagccggtatcaggaaaagaaagcgcagatgcaggcgcagctggaacagaaaaggaatttactggaacagctgaaggatgcggaaattaaagttctgaaagttacagcagaacaaaaagaggtttcagtaagaaaagaaacggcagaagacattcttattcaatataaaagataccaaagacagaagaaaagtgtggaagaggcgcagaaagcataccttgtcatgcaggaggaatgtacagagcgaaagacacagcttgcctggatggagagggcatttctggatgagcaggcggggattcttgcaaaggttctgaaaacgggagcgccgtgcccggtgtgcggatcggtccaccatccatgtccggcacagatgacggagggtgcaccggaaaaagaagagcttgaaaaataccggaaagagactgccgatgtggagaaaaagacgaatgatgcaagctttaaggcaaatgaaaagctggtccagttaaaagcgctggaagaagaaatccaaaagagtgtgaaaagttttgacagcagcatacaggaagaagagattgaaaaatcgctggcgttgatcggtcaacagatggatgccctcgaaaagtcagaaaaggaattacagaaaaagctggaagtagctaaagaagcagtggcagaaaagcagaagctggaagctgagatcccggaactggagcagatgcagaaaaagcttcaggaggaagaacaggagcgaaaggatcagctccttgtgtctgagagagataaagcaaatgcagaagagcaggctgtgaaggtgcgtggcaaactggaatttccggagaaagcagaagcagaacagaagatcaaagagctggataagcagaaaaaagagatcgataagaatctgaatgctgcccagaaggcattccaggactgcagtcagtcggtagaagcggcaaagacgaagaagaaaacgctggagaagcagattgcaggtaataaagaaaccgatatggaagagcttgggcaggcacgacaggaagtatcaggtgcgaaaaaagagcttcaaaaacagatggaagagatcaggatccgttatgagaacaatctgaaaatcaggaatgcgattgacaagcagagtgcgaaacttcttgagcttgagcggaactggacacaggtgcgtgaaatttccgatacggtaaatggaaagatcaaaggcggatccaaagaaaagatcaagtttgagacctacatccagaccaattattttgaccggatcattgcccgtgcaaatacgcggtttatggtgatgagtggaggacaatatgagctgaaacgccagactgatacggatgaccggaagagtcagagtggtctggaactgaacgtaatcgatcactacaatggttctgagcgaagcgtgaagacgctttccggcggggaatcctttaaagcttctctttcgctggcactcggactttctgatgagatccaggcatcggcaggcggaatccagctggatactatgtttgtcgatgaaggatttggttcactggatgaagagtcactggaacaggcgatgaaagcactgaatggtcttacggaaggcaaccgtctggtgggaatcatttcccatgtacaggaattaaaagcaaggattgagaaacagattgtggtgacaaaggaaaaagcaggcggaagcagagtggaacttaagattgactgatctgtgccggagaagaatttcatgctgagatgaagcggagcaccaatggaggtggggaaaattcaccgaaactggaaggagaagatgatttttatgagctgttttttgcaggactggagcagaaggaaaataaaaatctaaatgaataaaaatactatgaagaaatggttttgactttcagatatgcaacaagtgtgttaagataggtacagactattcataaaatgtgcaagaatatacaatttgaaaagagcgaatataaaaggaaaaaggagtaaaaatcatgccagtttttgattttaaacacacaccagatgaaaaaaaggcccaggaatgtacttatacaacattccgctcgaatgagacagaagcgacagcggagaaaccgatgctggttctggataacagcaaccggaaatggaagcatcattcctgtggtgttttcaccaacccgattaagaagacatcctttgaatttgacgaggaagatggaactgtaagtgcggacattctccagatcgatgcgagatttgtaagcctgatcaaatggctgggcgagaatcacatcaatgtccgtctttccggtgaaaaccgtgcagacggctatgcagtatacaagatccgggagatcgcattcggtggggcaaccaagctttcagctgaagatggtttcctgcagttcatgatcgagcgtcttttcgcaagcagtgcgccgacagaagaagcagtggatgaggaaatggaagaggacggcgacagcatgaagctgacaagtctgcagagtatcaccgattttatgaactgtgcaggaagaacccttccggacaatatccgtctgtgggcaagaagaaaccttgctgttgcaagatcacatgaagtgtcaccggaagaaagaagacatgcgcagagagctctttcaatcatgatgaatattcagtggaagagcaattattttgaatccattgatccggatgaggcaagaagaatcctggatgaagagctttacggaatggaacgtgtcaaacagagaatcatcgaaacaatcatccagatcaacagaacgcacactcttccggcgtatggaatccttctgatcggaccggccggaaccggtaaatcgcagatcgcttatgcaattgcacgtatcctgaagcttccgtggacaactctggatatgagttccattaacgatccggaacagcttacaggaagttcccgtgtatacgccaatgcgaaaccgggaattattatggaagcatttgcggcagcaggagaatccaacctggtattcatcatcaatgagctggacaaagcagcatccggaaaaggaaatgggaatccggcggatgtacttttgacactccttgataaccttggatttacggataactatattgagtgtaatgttccgacagttggcgtatatccgattgcaactgccaatgaaaaagatcagatcagtgcaccgatcatgtcccgttttgcagttatcgatatcccggattatacaccggaagagaagaagatcatcttttccagatttgcacttccgaagatcctgaagagaatgagccttcgtcaggacgagtgtacggtgacagatgaaggtcttgatgtgataattgaactttactccaatacatcaggaatccgtgatctggagcaggcagccgaacatattgcggcaaatgcattgtaccagatcgaggtaaatcatgtaaaagaagttgtgtttgacgaagaagcagtgagagcattgctttcataagaaaattaaaatatgaaaatgtaaatgatgataccagggtcaaaagattctatttctgttaatatttatagatgcagtaaaattgcagaaggagccggaaaagaaaaatagggtacgggtgactttgcactatggagatgagatccagtcaattgtggaagccattgctgacacaattgacggtttcgggagctcatcggaatgcccagtgcaacggaacccgtaccctatttttcttttccggcggtgcttatcattctacccctgtctataataactcaggaaatcagaaatttttcccacagcttctttcagaacttcaattcgtggcagatataccacccggaaatgatccggctgtttccagttaaatccacttccctgtacgatcaggatcttcttatcctgcagcagatccagtgcaaatttttcatcatttacaatgttgaacttctttacatcgatcttcgggaacatataaaatgcagcctgcggtttgacggcagtgattcccggaatgtcagtcagtgccttgtaaatatattcgcgctgttcgtaaatacgtccgcccggaacgaggtagtcgttgacgctctgattgccccagagagcggtctgaacgacagactgtgccggaacattggagcagagacgcatattggaaagcatcttgattccttcgatataatcttttgcgattgctttatttccgctgagaaccatccagccaatacggaatccggcgatcatatgggatttggaaagaccgctgaaggtgacgcagaacagatccggtgccagtgaagcaatggaaatatgttcttttccgtccataacaaggcggtcataaatttcatctgagaaaatgatcaggtgatgttcccttgcgagatcaacaatcttctgcagcacctctttcggataaagtgctccggtcgggttgttcggattgatgattacaagagctttggtacggtctgtgatcttacggcgcatatcttcgatgtccggataccagtcagactgttcatcgcagatatagtgaacagcctttccgccggcaagtgtggcacaggcggtccacagaggatagtctggtgacggaatcaggatttcatctccgttgtcaagaagagctgacatacacaggttgatcagttcgctgacaccatttccggtgtaaatgtcactgatcgtgacatttggcagctttttgatctgggaatactgcatgattgctttacgtgcagagaaaagtccctgagaaggagaatatccttcgcagtcagaaagctgctgactcatatcatagataacttcatccggtgtacggaagccgaatggagctggattaccgatattgagcttcagtacgtgggtaccgcgttcttccatacgggcagcttcttcaacaaccggtccacggacatcgtataatacattatcgagtttggatgattttttgaatatatgcatggcagaacttcctgcattatcgttatcatttttgtcggttattgtctttttcatcggtgtagttcccctttttgaagagtttgaagttccgacagaaccagaagtcttagtggtagacggagcttttggggcaacggagttgttttcccgagcagtaaagttttcctgactgtcaccgagcagccaatcggcatctacgtgaagcgtatctgccagaaaatggaggatatcatttctcggaacagtttttccgctcacgtactggcttacatggcttttacctaattttacattattttctgcggcgatatgaaccagatcaatctgtttcaggttctgggcatacatcgcctctttaagtctatctgagaaagttgtcatttgagaatctcctttcaaactaaaaagttcaatttaagaataaaacagcaaagttcaaaacttaaattgattatagcacttcgaatgatttggttcaataacaaatattatttttggttcaaaaagtttgattctagcaacggcaccctgaaaaaaggcggtatcccgccaaaattcagatgctctggtaacttagttgccgagtagttcacaaataatgataagtattacgtttcaggacgataaaagttccggtaacgcataaagttaaaagttcagcaattgcaaccgagcaccagactccgttgataccgagaagcagtggaagtagcagaaccactgccatctggaagaccagtgttctgagaaacgagatcagcgcagagagcagaccgttgttcaatgcggtaaaaaatgcagagccataaatattgaacccgttgatcaggaacgcaaagctgtacagacggaacccactgcgtgtcagttcaaaaagcccctggtcataaccgacaaacaatgtggcgagtggtgttgcgatgagctgcgcgatgataaataaggaaacagcccaggttccaatcagccggatactcttgtggaaaagattctttagttcatcctgattgttggcaccgtagtgatagctgacgatcggggcacttccaatcgcataaccaaagaagatcgaaacaaagataaaattgacatacatgatcgttccgtaagctgcaacgccgtcctcaccggcaaatttcatgagctgcatattataaagagcatttacaacagagctggaaagattggtcataagctcggacgagccattggtacaggtctttaataagattctgccatgaaaatgtgtttttccaagctttaataagctggaatttttccgtccaaagtagaataacgggaaaagccctccgataaactctccgcatacagtcgcaaacccggcaccgggaagtccgaggtggagtacagctacaaataaaaagtcgagaaccatattggtcacaccggcgatcacgatcacgcgaagtcccagatgtggcttttcggcagttacaaaaaagctctgaaatacattctgcagcataaaagcaggaagcgaaatgcaaagaatacgtccatataaaatgcagttgtcaagaagagtaccgcttgcaccgaataaaatggcaaccggttttacaaggaacatactcagggttgcgataatgattcctccgatagcagtgatatagacgagcatggaaaaatactcattggcattttcgatctttccttcgccaagcgtctttgcaacaatggcactaccaccggttccgatcatgaaaccgagagcgctgatgcccatcagaaaaggcatgatcagattaaccgctgcaaaagcgctttttccaacaaagttggagacaaaaagtccgtcaaccacactgtaaatggatgtgaagatcatcattataatagaaggaaacacaaattgtagaagttttttataagtaaagtgttcggataattgaattttcatagtttatagatcctcctcaaggttagaaagcctagaacgtaaggtctgattatatttggcattcaggcgcagaagctgttcacattcttcgggactgaaagaagctaaagtatcattttcaatctggatgagaggaagcagcttttcctgaataagcttcttgccggaagctgtaagatggatatgcatacttcgtccttttccgggtgagagggtaagataaccgtcggtctgcagtttccggatggatgaattaatcgtctgctttggcaggcaggaggccttgcagatatctcgctgcagacagttatcgcctatttcaaaaattgtatagaagatgtctaacgcactgtccgaaagttgaagttttcgggcaatctcgtgatagatgtcatttgcttctttatatatgtgattgtattcttttaaatatttgctgataagtacagtagaatccgtgttcatggctcacctcatttaaataattatgtatatttcgaaatcagatgatagtaagtccgaaatcgtactcggtatattgtagtctgaattcggacttatgtcaagtggataataaaaagaaataagctgtgcataatgcataaaatctataaatttttaaggaatgattaaggctgtgtatgtataatatcaaaaaagaaaaaaggtatgtaatcatgtgatttgtatacatttacaatacaagtatagagaaaatgaaagttgtattgttagttcatgaaaattttacacataacgcacaaaaatctagttttcactgaaaaaaaacgatcactataaggacataatgcacaaaatgaataaaaacattacatttttgatggataaaatacacgtttaaaatacaactttgaacaaaaactttcttgtattttcttgaaaagcacagactcaaataatataatcaaatcatcaagaaaatggagatggaggagaagatatgaaaaaagttttcaaaaaagtaacagcagctacaatggcagctacaatggtagtcggacttgctgcatgtggtggtagtggaagtggatcttctgacaagagtgcttcaaaatcagacaagatcaaaattggtgtttctatttggtcttcaacagacgtacttggatcacagtgtaagaagatccttgatgaagcagcaaaagctcttgatgtcgaagtacagtatgttgaccagggacatgtttctgaaaaagttacagcatctgtagaacagcttgcagcagcaggatgccagggaatcatcatctgtaactcatctgatacagaaatgacatctgctatcaagacatgtaatgacaacaaagtttatcttgcacagttcttccgtgtaatcagtgaaaagaacagcgcagatatttatcaggtagctaaagattctgattactacatcggagctgtacatgaagatgaaccggcaaacggtgaagaacttgtaaacatccttcttgaaaaaggagatcgtaacatcggtcttattggctgggagcagggagatgctacatggcttggaagatgggaaggttacaaagcaggcgttgaaaaatggaataaagaaaacccgaacgataaggcaactctttctgaaccacagtatgcaggtacaacttcagaaggtggatcaaaagcagcagaagctttaatggcagcagatccagatcttgatgcactgatcccagctggtggtggtggagatccacttcagggagcaatcgcagcagttgaacgtgcaggcaagacaagtgatattgatatcgtttctacagacttcctcccagaccttggagaaagacttgaaaatggatctatggctggtgaatctggcggacattactgtgacccactgatttccttcatgatggtttacaatgcaatcaaaggaaactacaaagacttcggtggcaaattcgaagatgttccattcccatatctgtatgtatcatcaccagatgactacaaagcatatgagaaatatttcgtagaccagcttccatacacagatgaagaactggttgacatgtctaaactcagcatggaagacttaaaggcaacagctgctaagttatctattgaagatgcagcatcacgtgcaggtaactaggatagacaaatagtaacgactattaactcagaaagggtgacgtcgcaaaggcgatgccaccttttctaaatcagaaatgacaattatgaagaggtagataatatgggcactagtaaaaaactttcagggaaagtgatgggatatctgatcttaatcggtctggtcgtactttcctggctgatctttaaaatcttgacaccacataacttcggttccttttccaatatgctcaattactttcaggcgagcctgattgctaccgtaggtgcagttggtttttattttgtaatggtaatgggaatgttcgatttctcaattggtgcaaacatcatgctttccgcaatcgttggatgtgtatttgcaaccagattcaacatgggctatttgggacttattattggatgcgttcttacaggcgcaatcgttggaatactgaacggtatcttctatgtaaagcttcgtattccatcaatgatcgtaacaaccggtctggctcttatttatgagtcaatcgcaaactatattgcaggcggtgttgagcagacgcttccggcaaatattcgtgcatttggtcagatgccatgggatattattcttgcattagtggcttgtgtagtagcttacatattcttaaactatactaaaatcggaacttatacctatgcaatcggaagtgatgaattcgttgcaaagaatatgggtattaacgtaaataaatataaagtacttgcatttatcttaagtggtgcgttccttggggttatggcaatcctgacaatcagctatggttcatctatggtagctgttaccggaatggcatctatgagccgaaacttcgttccgaccatgggatgtttcttcggccttgcatttaagaaatacggaatgccgcttccggcaatcatcatcggtgagttcgtaatcaacatcattttcttcggtttcattgctctcggagcaccgactgcaattcaggatgttatcacaggacttgcactgcttattatcattactgtgacaacaaaggctactaagggcgaaatcgtcaagtaatgaagggaggaagacagcaatgagtgaagtaagattacaggtaaaaaatctttgtaaaaacttcggtattacaaaagcagttcagaatgtatccttcaatgtaaataaaggagaggttcatgcgctgatcggagaaaatggttctggtaaatcaactctgaccaacatgctgactggtatctacagcattggaagcggacagttcattctggacggaaaagaaatccatccgaagaatcaggtagaagcaaataatgaaggtgtatctatcatcgtacaggaacttggaactctgtcagggcttacagttgcagagaatattttccttggacatgaggatcagttcgtacattttggaattaaaaatacaaatgctatgaacaagaaagcaacagagcttttaaagaaatatggttttgacagaatcaaagcagctgatatgatcgatcattacaattttgaagaccgtaagctggttgagattgtaaaggctacatactttgatccgaagattgttgttattgatgagacaacaactgctctttcacaggaaggacgtgaagagctttacaaacatatggaaagaatcaaaaagagtggaaatacagttattttcatttctcatgaccttccggaaattcttgacaagtctgatacaatcacaattcttcgagatggtgtttacatcgataccgttaagagtaaagatgtaacagaagatgatctgaagaagctgatggtaggacgtgaagtaacaggtgattattatcgtgcagattatggtgaaaaagtatctgacgaagttgtattatcagtaaagaatgttactgttcctggattgatcgaagatgtaacatttgatcttcataaaggtgaaatccttggattcggtggactttcagaatctggtatgcatgaaatcggaaaagctattttcggtgcatcttatgaccgtacaggtagcgtaacactggcagatggaacacagattaatgatattccgactgcgatcaaacacagcattgcgtacacatcaaaagaccgtgataatgaatctgttgttctgaatcagagtatcggagacaatatctgcctcccatcactggatgaactggcaggaaagtcacatcttttaagtgataagaagcgtaaagaatttgcagacaaatatgcaaaacagatgtctgtaaagatggtagatgtaaaccagtttgtatcaaatctttcaggtggtaacaaacagaaagtcgttcttgcaagatggatcggaaaagattctgacattgttgtactggacagcccgacacgtggtattgatatcaaagttaaacaggatatttaccagttaatgaatcagatgagaaagaatggaaaatccattatcatgatttcggaagagctgatggagctgatcggtatgtgcgaccgtatcgtaattatgaaagatggaaaaatcagtggtcagctggatagagataagaaccttgatgaaaacggtcttatttctatgatggtataaggaggcagctatgggaagtcaagtaagtgcaaaaacaaatgataaagagcagcagctgaaaaaggcatctaaaatggccttaattcgttcgctcctgccaatcgtgggattggttgttattttcctgttattcaatgtcctgacagatttccgtatgatgggaaatatgtcactggtactttcacaggtatatgtaactatgattgcagctatgggtgttttcttcattatgacaatgggaggtctggatttctctcagggatctatcctcggtatttcatccatcgttgtatgtattctttcacagaaaagcattccactcgcaattatcggtggcattgcatctggtgcggcaattggagctctgaatggttacttctatgtattccgtaagattaaatccttcattgttacaatttgtaccatgttcttattccgtggatttatcaaatactttacaacaaatgcacctgttgcgggttctgcaaaactgatcaactatgacagtacaggacttaagattgcatgtacggtagttattttgattattggattcattgcattccgttatacaaagttcggaacttatctgaaagcaatcggagccggtgaaaaagcagcaatgttctctggtatccgtacagataagatgaaattcctcatctatgtacttgcaggtgcaattacaggatttgcggcatttatcaatgtaatcaaagtcggatcggttacatcttcaggtggtaaccagctggaaacacagattctgatcgcgctggtattaggtggtatgccgatttccggtggcgcaaaggttcgttttgaaaatattgttgttggatctttactgtacatcgtactgaacagtggactgacaatgatgggattcacaacacagatgatgcagctcattcagggggttgtattcctgatctttgtggcagtattcgcagacagagaatctatccaggtaatcaaataataatttacatagtggggaactgacagttctcgtttacgagaagaattttccggatgtatacagatcgaaagtcaggatttgcagtccaaataagattgcggatcctgatttttggtctatgtggcagaaatggagagtttatgcataagacagaacaggaaggacttaaataccaaaaattatataattgggcacacacactgatcaccagtggtgtgattaaaaatatggataaatttccgtcagagacaagccttcagaagaagtttggatattccaggcagacggtaaggactgcattgcgacaactggaggaagaaggtctgattacccgtgtgaggggaagcggaacctatgtttcttatgacagcagtggagtaaatggagaaagaccacaaataggtcttcttttgagctattattctgattatctgtttccgcgggtatacgacgggattgaagcttcgctgacagaaaaaggatatggaattgaggttgcggtaacgaagaaccgcctgaatgatgaggcgatttatctggaaggtctgctcaaaggaaacgtcagtggtctgatcattgaaggatcgagatcggcatttccaaatccaaacattcgtctttataaagaaatcaaaagaagaaatattccgacactgtttatccacaatcattatgaaaatatgccatttgacagtgtagaaatgtcggattccagatcagcttacgagttgaccaggattctgattgagaacgggcaccgaaggattggcggaatcttcaagtatgatgacaggcaggggattgagcggtacaaaggatttgttcagtgcctgtcagattacggcgtgaaatttgatgatgactgtattcgttggtattcgacgaaggatatggaggagaaactgagcaaaaagggactgcttaggatgtacagacggacgaaggattgtacggcgatgatggtctacaatgatgaggtggcggattattacatggagttcctggaagagagagggctgcatgtgccggaggacatttcgctggtatcttttgatgatgcagagcttcaggattcgagtaccagtatccagctggtgacagcggtgcatccaaagtatcagctcggacgtatcacagcaaaacatcttctgcggatgatggaggatccggaatggcagcagaaaaattattcgtaccggtttcctgtaaagattagagatggaaattcagtgcggaaaatatagaaagagtgaaaagcaggtgacgaaatccggaaggactgtcatctgcattttcaatataaaattttatccataatcgtgaaaaaagtaaaaattatttcagatagtacttgagatttgtcaaaagaaaggaagacagatcatgatctatgaacagatcattctgattgcgatcggagaaaagggagagccattattaaaggtgattgattcctgtaacgaggtgtgtctgaaggtaatcagtactgttatgtattttacaccgatcggtgtattttgtaccattgttccggttgtagaagcaaatggaacgagtacgatcgtatcactggcaatacagctgatcattctgtatgttgcattttatggatttgcatttattgtgtacggcggtgcagtaaaattttttggaaagacaagtccgtttaagtttttccgcgcgatcatgccggcagcactgaatgcattcggaacctgttcaagctcggcaaccattccgatcagtaagagttgtgtggagaatgaacttggtgtttccaaccagatttccagtattgcaatcgcatcctttgcggcacttgctacgatggcaggacttccggcaggagttatgggtgtctatatcagcatcaatacactgtgtgatatgggagcaacctgtgtgaatgttattggtgatatggcaggctgtgtggtactgcaggagaagattgatctgaagtaagaagaaatagatgaaaacttaggcagctggtctgaaaagatcagctgcctttttacatattattcatctaataatttgaatttcgtatacaccggatcatgatccgagtagctatatccggtatttacattttcatattctgtgcattcaatattatcggaagtaataaatccgtccagcgttaccgtgtaggtcacaccaggtacatattccatatctgcattccgtgcactgtcccagagagcatccttttcactgtcagaaagattgtccaggcagaatgaaaagtgttccggaagctcttcgcgtgggaatggataagcccaggactcacaattttctgcatctttttcggatgccttaaggtcatggttgaaatcaccaccgcaaagtacataattaccggcttcgtattccttttccatatctgcactcagcatacggatctgtgcttcgcgaatcgcatcactgttgccgtaagcagacatgtgaagcaggaagataaccagttccttcccgttatctacagggactctggaaatgctgtaacagcggtcaaggtcaaagaacttgctgaagcttgtcgatatcggaaagcttcttctcagagaatccgtaaccggatatttggagaaaagagcaagtccagaacggctgcgaccatgcggctgtgtgaatggataaaaaaggaatgcagaatcgtaattctgtgcaaataccgtattgtaacttggaatcgtatcctttaaaattgaatattcatctacatggtagcttcgtgtagagttcagatcaacttcctggatcagtgcgaaatccggatctttggaagcaaccagttctccggcaccctgaatatcagattcgacactctccttactttttgcccaggaagattttccgccgtccataaagaagctgaagtccggcgtgtaggcttcgaaaccaacattgtaggtcagagcggaatattctttttcggttgtcagtgtgtcagctgcggctgttccatcggaagttttctcgatcttcaaagcctgattatccggaatgcggtgatagcttgcaaagagatagatcagatatgcaatcagcgcaaccagaatgataagcaggaagattccgagaacttttaatatctttttgatgttctttttcataatatcccctttttgtttgttaaatttcagataactctatgtaaaatctaagtttactatagcatgtctaaaagattatttctatagaattgagaaaagaaaaaaggcatagtaacttataaaataaagcgaaaaatctaattgaagttcttcttgcatctcgttataataggaaatggagaaatgaaatcacaataatattggggaaataatatgtgattagatccgagtatttatttaatgtttgggaggtttaccatgaacgaaaagaattacagcaaagtaccagtatttgagaacggacttgcacagccggtatttccacttacagatggaaagacaggagaaaagtatgatccggcaacatccagtatcgtaagatattgtgtttatgtggaaacggattacgatgtggacggagatggaaaaagagatcttgtgaaagctgttgtccaggtaccaagaagtgcagtagaggggaattataaggctgcaactttatatgaggcacgtccatatgcggcgggagtccaggaagatggatatccgcatatgaaagaagtggcagaaaaagaatatcatccggttaattttgcagatcttgacaaaaaagtggatgcgcatgttccgcagggatgtatcagtgcaatggatctttctttaaaagcagatccggcagactggtattatccggataaaggaaataataacattatggtttttgaaaatatcgacacctttgattattatcttgtacgtggatttgcagttgttttaagtgcgggatttggttcaaaaggatctgacggattcaattatgttggttcagactatgaaagagacgctttcaaagcaattgtagaatggctgcatggagaccgtatcggatatgcagaccgtgaaggaacggttgagacaaaggcagactggtcaaacggaaaggttgccatgacaggaagatcttacgccggaaccatgccgtttgcagtggcaacaacaggagtagaaggactggagacaatcgtaccgatcgcaggaatcgcagactggtacagccagcagaacatgcagggcgcacagcggtactggccgaaagaaatgctgaacagcttccttgcctatttttgttccagccgctataatgatgagacattaaccgagaagcagcgggaggatatggcagcattccatcatgagatgagtcttcagcagatcaagggtggatttgactataatccggaattctggggtatgggaaattatcgtcttcatgcagaccggatcaaatgcagtgcactcatcgtacagggactgaatgacgagaacgtgtctaccaagcagtatgagatgatgtacaaatctttccagaaggcaggaaagaatgtaaaagcaatccttcatcagggtgcacatattacaccaacgatgccgaagcgatatggaatccttgtggatggtaaattctatgatgatattatcaatgaatggatttctcattatttatacggagttgaaaatggtgcagagaacagaccggcaatcctggtgcagatgaactatgaccagagaaaatgggagacagcagattcctgggagacagcatataagatgaatcttacatgcgaagaacagggaacaactgtaatcgatacagactgggaagcagcgggtgtcagtgcagagaacttcgatgatgtgatgggtgtgagatcaagcaatatggcacagcgttatgtgacggatccatttaaagaggcagtgacattacagggaacaacctgcgtaagattaagagcagcgttaaaagatggagatgcagaagcagatttcaatccggtaaacagtaatgatgcagatactctgacgatgaagcttggaatgcatgaaatgtcaggacgtatggatgatgtgaagcttactcttcttctttgtgacgtgtgcgatgaagaatttgacagcattcagtctgtagatccgcagagaaatacaattccggtcaatgtggtaaaagaaggcggaattatcagcggaggagaggttccggcatggaatgaagcggagtttgctactgtacataagaaataccgtgtgatcacacgggcatttgcagatctgtgcaatccggaagcaggatatgaaccggagacagcacagaacagtatcgaactgaaaaagggtgaataccatgattaccatatttatctgaatgcgacaagatatacggtagagcctggacatagcctggcactggtcatcacgacagaagatccgatcaactgtctgatccacaagacctattctgtggaaatcgagaatgcatcagtgacagcggaagttccgatgactgaagcggtagaaaatcgcgtgatgacgagaaaataaattacataaaaggatagttatataagtatttcatgaaggatcaccaattcccggaaacaggttttggtgatctttttttcacagtaatgcagatgtagcctatgcttcacaaaaattttttcacatatatcgggataattctttttattttttgtaaatattgtaaaataattagaaatggaaataacaggaaactgcgtggtagaagtctggaggaaaagacatgaatgcggaagaacgaatgacaaaaggacaattagaagaagaaatccaatattttcggaagatctttcaggagatccgtcttttcccaattggaaatatatcagatattgatgaagaatggagaaaaatcaacgaggggcagagctgctatcattattggaaacgggaaacaccctgtgataactgtgtagtgatgcgtgcagcgaccacgaaagaagaaaaaggaaagctggagattgtaaatggcagaatttatcaagtgatcgcacgttatatagaagtggatgagaagccatatgtgatcgagctgatccgttgcctggatggtgactggtcgattggagagattaatcatgagcgtttgatagatatatttgtacattacaatgacaagctatacagagatgcagtgacagacgcatacaaccgacggtattatgaggatgagatgaagaacaagaagaaaaatgccggggttgcactgatcgatctggatgattttaaactgcataatgatatctacggacatcaggcaggagacatggcactctatactgttgtagatatcatctggaaaaatatccgaaagacggataaactgatccgttttggtggggatgaattccttcttgtgatgccggaagttacggaagaagtttttagtcagaaactgcaattgatacaggagagtatctataatacaaatgttccgggatacccgaatttgcgactttctatcagtgcaggtggcgtgctgacggaaggaggcagtattgaggaagccgtgaacagagcggacaagctgatgtatcaggcgaaggctatgaagaataaagtggttacacagaaagataaaagagagcagtacgggaagcagatccagattaaacagcggattctggttgtcgatgattcaaagatgaaccgtgagattctctgcgagatgctgaaagatgattttgagattattgaagcgacgaacggacaggaatgtgtttcgctaatagaacaatacgggaaagagatatcactggtactgcttgatatcgtgatgccggttatggacggttttgaaattctgatgtatatgaaccggaatcactggattgaagatgtgccggtaattatgatatccagcgaggaatctgagaactatatccggaaagcgttcaagtttggagtatccgattacatcagcagaccttttgacagcaaggttgtataccagcgtgtatttaatacgatcaagctgtatgcaaaacagagaaggctgatttccatggtatccgatcagatgcatgaaaaggaaaagaacaatcagatgatggtagaagttctaagccagattatggaatttcgtaatggagagagcggccttcatgttgtccacatcaatacattgacgagacttcttctggaaagacttgttgagaatacggatgcatataatttgacgccggatgactgctatctgatttcaacagcatccgcgtttcatgatatcggtaaggttggaattgatgagtcgattctgaataagcctggaaagctgactaaagaagaatttgagactatgaaagagcatacgctgattggtgcttctatgctggataagctggagcattataaggatgagaagatgattaagatcgcgtaccagatctgcagatggcatcatgaacgttatgatggtaaagggtatccggatggtctgaccggagaacagattccaattgcggcacaggttgtatctgtggcagatgtttatgatgcactggtgagcaagcgtgtatataaagatgcgtattcacatgagcaggcgatgaagatgatcctgaacggagagtgcggagcgttcaatccgcttttaatggaagttcttgtggaaatccaggataaaataaaagaagaaatgcattacgaagtataaaaaagaagaaatgttcggcagaaacgtccgccatgaaaaatcagttgtatttccctaacgaattgtgtataataaataaaatattcattttatataccaaaaataagaaaatgaaagatgaagaggaaaatctttcaatcctggaggggaataagggatgttatctacaattgagtcggtcaataatgtagtcaataattttatctggggtgtgccggcaatgatctgtatcatcggagtaggacttctgctcagtgtcagaaccggatttatccagatcagaaaatttccatacgctatgaaggtgacgattgggcgcatgcttcggaaaaaagatgccacagatggtgcaatgacaccatttcaggcggtctgtaccgcgcttgcggcgacggttggaaccgggaatattgcaggagttgcaggagcgatcgcaatcggcggaccgggagcagtcttctggatgtggatctccgcacttcttggaatgtgtactaaattttcagaagtaacacttgccgtacatttccgtgaaaagaatgcagaaggggatctggtcggtgggccaatgtattatattaagaatggtctgaataaaaactggcactggcttgcatatttgtttgctgcattcggtgtgctgacagtatttggaactggaaatgcgacacaggtcaatacgattacgacagcaattgattccgcattattcaattacggggtgattggagtggatgcagcaaagacggtcaatcttgtgatcggaattgtgcttgcggtgttgattgcactgatccttctcggtggaatcaagagaatcggacaggtaacggaaaagcttgtaccgttcatggcggttatctatgttctgttagctgccggagtggttctgttgaatttaaaaaatataccacatgtatttgtttcaatttttgaaggtgcatttacaccgacatctgttaccggaggggcagtcggaagcttctttatcagtatgaaaaaaggtgtgtccagaggaattttctctaatgaggcaggtcttggtaccggatcgattgcacatgcatgtgcagatacaaaaaaaccggtgaaacagggattcttcggaatctttgaggtatttatagatacgatcgtaatctgtacactgaccgcactggtaatcctgtgcagcggagttccgattggttacggggaggcagcaggtgcggagcttacgattcttggatttacttctacatatgggagctgggtatcgatctttaccgcggttgcaatgtgctgctttgcattttcaacgattatcggatggggactttatggaaccagatgtattgaatttttatttggaacgaagatcaacaaaccgtttatggtgctgtattcactggttgcgatcgtcggagcaacgatggatcttggactgatgtggaatattgcagagacatttaacggactgatggcaatcccgaacttaattgcagtctttctgttatcaggagttgtggtaaaacttgtaaaagaatattttgcaggggaaggaaaagacgcataaagaaatacctgacagaaagctagaaggctttctgtcaggtgttttttaatttccaaaatcaacgccatacattttaaaatgtgtctcaatacgctgtttggcttcccaaagaatctggacagcttctttttctttagactcggaaatacggaaggttgggatggatatacttaaagcagcgattggtgcattattgtaatcaagcgaaacggcgatacaatttaccattaaagttgtttcttcatgttccacggcatatccccgttgacgggtaagttctagctctttaagtagatcatttatggtagcgattgtgtgtggtgtatatgcagtgagaacttctggaaacaggctacgaatttcttcttcggatttataagcaagaagtgctcgccccaaaccagtacagtacaaaggaagctgctttcctacggaagacatcaggcggattggctgaggtgaatccttttttgcgatataaaataccatgtttcgagattggataccaagttggcatgtttcgttacttaatgcagtaatgttattcatctcctgttgaatgaattgtaaagaagtcttgcggttattataggctacaccaacagaatatgtagcaactccgatacgatagcgaagcgtatccttttgcatataaataaaattacgggcagtcatcgtatgaacaagcggcataatgctgctttttggggcattcagtgctttggcaagttcggtaagagtcattccttcctcagagttggaaagaagctccagtatatcgagcacccgttcagtagggcggtgttcagttgttgccattggtttaaatctcctttattaacattgaaataatctaaagttcaatcaagtatataaaaattatatcagatatttgtatggaattccagagctgtttgacgtatatgtagaaatttatatagaataattgtgcaaaatgataaaaataatgaattcatttaatgatatattgacaataaaatacataagtgctattttaaaagcatgaagtatgtaaatacatacggagtacgtatatacgcacaaatgaaacgaaaggaaaaaaggtaaagaggaggcaaaaaactatgattatgaactttttgaagaaagtaccggctgggatgatgattgttccgcttttgattggagcaattttaaatacgttctgttcgtcgatacttcaggtaggttcacttacaacagcaactttttcaaatgcaggtgcggcaacagcgatgggaattcagctggtatgtcttggaacaacgttaagatttaatgaactcggaagtgtgttaaaaaggggcggagtccttttgatttccaaatttgtggctggagcagtaattggtattgttgttggtaaagtgttcggtacagatggatttcttggattatctgcattagcaattatctgtgcggtaacaaacagcaatggttccgtatatctttccctgatgcagtcttatggtgatgaagtggatagtggcgcaatggcattactctcattgaatgatggtccattttttacactggtcgcaatgggagcttcaggacttgcaaatattccgattctttcaatccttgcagcaattacaccgatcattgttggtatgatccttggaaatcttgataaatcattttctgatttccttgcaccggcaggaccgattttaattccatttgtaggacttacacttggagcaggaattgatctttccgcagttataaagggaggaccgtcaggagttctgcttggatttatgactacttttattggtggagcatttattgtattatgtgatcggaagatttcaaaacgaccgggttatgccggatgggcagtagcgacaacagcaggaaatgcagtagctgtaccggcagttgtaggactggcagataagagtctggaagcatatgtaccacaggcaactgctcaggtagcagcatccgtagttatcacagcgattattgtcccaattgttacaaactggtgggcacataaatacggatgtccgaagttcccacttgaggataagaaagcagcaacaaagtagtatttgtaaatatcacatattaaaaaatgaaaacaggagatgagcaaaaaggtagtaacagttaatgcagcaattattgatgaaaaagataccgtcgttgtagcaattgaaaagatcaatgcaggagatgaagtgatctggagagatagaaatggagatgtacagaagattaaagctataacagatgtaccaatgtaccataaagtagcgatcaaagaaatgccaaaaggaacagaagtagtaaaatatggggaacatattggtcttgctgcctgtgatatccatgtcggagagcatgtacatgtacataatgttcagaatcacagagaaaatctttaaaatacggaatataagaagacaggaggaagtttaaaatggaaaaaatgactttttggggatatagaagaccagatggaagagttggaatcagaaataaaattttaattttaccggcaagtgtctgtgcatcagatacaacaagaattatcgcgtcccaggtagaatctgcagttacattcaataaccagaatggatgttcccaggttccgtcagatcagcagttcacgatggatgtaatggcaggatatgcagcaaacccgaatgtatatggaacggttgttgtatcacttggatgtgaaaactgtcagatggatcttgtgttagatgcaattaaagagagaacgaataaaccaatccgccatttcattatccaggaaaacggaggaacgatttctacagtagaaaaagctgtccgtgcagcaaaagagatggcacaggaagcttctctactgcagaaagaagaatttgatttttctgaactgatcattggaactgaatgtggtggttctgacccgacttcaggacttgctgcaaatgttctgatcggagagatgagtgatcgtatggtagaacttggaggcacctcaattctttctgagacaacagaatttattggtgcagaacatattctggcaagacgcggaaagacaaaagaaatcagtgacagaatttaccagatcgttcatgactatgagcatgcaatcaagttagtaggacatgatatccgtgaaggaaatccttctccgggaaacaaagaaggaggacttacaacactggaagaaaaatcattgggatgtatccataaaggcggtcattcagaagtaacagcagtatatgactatgcaaaacaggtagaaccaaaacagggacttgttattatggacactccgggaaatgacccatcatcagtagcggcaatggtagccggtggatgtcagattgttgtattttctaccggacgtggtacaccgacaggaaatccgcttgcgccggtaattaagatcaccggtaataaagttacttttgcaaatatgtccgataatattgatattgatgcaagcccgtatatttacggaaccaagacgatgacagaacttggtgatgagctgatgaaagaaatcaaggaagttgcggatggcaagctgacaaaagcagaagctcttggatatacagaaatggcaatagcaagagtttgtaactatatgtaaaaatggggtggaaaaattgcgttataccagagtaaaagataaaaatggagaaattcatctggcagctttcgaaaaggaagaaaccgtattttttctggatgaattattcccggaattaaaagggaaaacgttgatagattttgttcatatggtaaatggtgatccgcaaaaagcagcacagatgatctgtgctgcagatggatcggtacatagaatggaagagcaggagatgcttacaccgattgaacgcccggttcatgatattctttgcgttggagtaaattatacagatcatctggaagagacaaaggaacatttggcaggagctgtgtcggatgaagtatccggtaccgtgtattttgcaaaaagaacaaaccgtattcttggggcaaatgaagagatccagggacggtttgatatcgatgaaaaagtggattatgaaacagaattagcggtcattataggaaaagaaggaaaaggaatcacggaagaaagagcagaagaatatgtatttggatattccgtatttaatgatctttcttcaagagatcttcagactagacatggacagtggctgatgggaaaaagtctggataattatacgatcatgggacctgtgatcgtagaccgtacagagcttccgatgccgttagaactggatattaagagttatgtgaatggtgaactcagacagaattcaaatacaaaatatctgattaaaaaaattccggggctgattgcagaattgtccaaaggaattactctggaggctggtgacattattgcaaccggtacaccagcaggtgttggaatgggatttacgccaccaaggtttctaaagaaaggtgataaagttacatgtgagatagacaggattggtcagctgacgaattatattgtctgatttttacaagaaagtgaattaggataaagataggaagagaggtagaaaatatgtgtaaaatcgttacaccagttgttacagtttttgatgaaaatgaaaaaccggattatgaagggaataaaaaggtaattgatttcctgattgaaggaggcgttgatggaattcttgtgttgggatcgtccggtgaatttacaggacttacgaaacaggagaaacatgatttcttcaaattctatgcagattatactgcagggcgcacaaagctttatgctggaaccggaagccttaattttgaagatacggtggcgttgtcaaatgaagtgaatgaaatgggctatgaaggagcaatggttatcggaccatgttattatgcactggatcaggaaaagatttttgtatattatgatacgcttgcaaagtcaataaaaggaaatctttatatctataatttcccggcaagaagtggacattccatcgctccggaaaccttgaaaaagctggtggaaaataatgctaatattaaaggtttaaaggactccgtgtcagaaccaaatcatacaaatgaactgatgttggctgtagaaggacatgagtttgagatgttctcaggatttgacgatcagttcctttataatcttacatccggaggagtaggatgcataggagcgctttctaatattgtgcctgaaatctggagtgatcttgtaaaatcaacaaaggaaaaagattttgacagagttatgaagttatcagcactgacacatgaactgatgccactttatgacatggattcaaatttctcgctcttgttcaaaaaactaatgcaacatagaggagtagaagtttcggatcgcgcaattttcccatacaatcagatggatgaagaagtgtataaaaaagcagaaagcttgatggataaggtgattgaggagtatcagaacctgaaataagaagaaacaaagcagacattctgaaatggagaatcatccgttccggtatcagccggggactgggagagattctccatttttatttaatcatgatttattcatttacttcaaaacgccattgctgtctgacacctggatatttctggtgatcgacttcgctcataaacatatcatatggtcttgcacagattttgaatggtgcatacattgcctggtagacaaccagcttttcgcctgtttcggtatgctcggcgaaagccagtacattgtagagatatttggtgctctcttctgatacccattctcttttgaaatggcgcacgatatcgccaacatggatttcatggaggggttctgcgttatttttttcggtattggcagaaagcgtagaagcaggctgtgcttctgggataaccgtactggtttgtgttgaggcagacgattccgggtgggaaattacagacgaagaatctattttattttccggatctgcatccagataaatatactcatctttatcaagagaaaccggtgcgccggtcttgccgatgatatgaacaccaccataccaggtgtcctcgattttaaaagtatctccgatctgatattcggaagaatattcatcgttcttttttatgattttgattttattcatagataatacactcctgtttgtatttgaaaactaatctaattatatgtgcattttccaatttttccaacctaaaaatgggaaaaatcgtgtatactggaaagtactagttgctggccacagatactgtgaacagtaactagtactacggaaaggggaaagataaaatggtaaaaccaattatgagagatctcttttttctgcgccagaaggcagagaaagcaacgaaaggagattttccagttgcaattgatttactggatacattaaaagcgcacgaagatggctgtgtgggaatggcagcaaatatgatcggggtaaataaagcgatcattgcagtcaatatgggatttatgaatgttgcgatgttcaatccgaagattgtaaagagaaacggaaagtatgagacagaagaaggatgcctgtctctggatggtgtaagaaaatgtgtgcgctatcaggaaatcgaagtagaatatgaagatatcaattttaaacggcagagacagaaatacagcggatggacggcgcagattattcagcatgagtgcgatcatctgaaggggattattatttgatggtatcccaaataaaaggtccggcattatgatttcacgttttgtggaaagaaagtcctgattggaacagataaatcggaataatgttgttattacaacagaaatgaaaatccagaaaccgtatacttatccatacaaaaaaagaaggtcattaacagttaaagataaattataaaatcatataagtagatattgagttttataagatattagactagaatattattgaaaggaattgatactttgagtaaatattattctatacacgaattttcaaaaattataggcgtatctgctcagacattacgaaattgggatgcaaatggaaaacttcatccgcatcatactacagtaagtggctatagatattattctgatgagcaactcaaccaggtaataaatgtaaagcctaaaaatcgcattacaattggatattgtcgcgtttccagccataaacaaaaagatgatttggaacaacagattgataatgttaagacataccttttggcaaaaggacagccgtttgagataataagcgatatcggttctgggattaattataagaaaaaaggacttcaggaattgattagacgaatctctcaaaatcaagttgaaaaggttgttgttttatataaagacaggctattgcgatttggttttgagttgatagaatatatcgctttactttataattgtgagattgagattattgataatactgaaaaatctgaacagcaggaacttgttgaagatctggttcaaataatcacagtattcagctgcaaattacaaggaaaacaagcgaacaaagctaagaaacttatccgggaattgatacaggaggaaacagatggtaaaagccataaaagtaatgctgataccaaacaacgtacagaaaactaagatgtttcagtacgcaggtgcttcaagatttgcttataactgggctttggccagggaaaaagaaaattatgaaaaaggtggtaaattcatttcagattcagaactcagaaaagaatttacaaagctcagatattctgatgaatacgcatggctgctgaatatttcaaataatgtaaccaaacaggcaatcaaagatgcctgtactgcgtataagaactttttcaagggtttgcaaaaattcccaagattcaagtctaaaaagagatcaatgccgaagttctatcaggacaatgttaagatacaattcagtaatacccacgttaagtttgaaggcttttcttccagcaggaaagcaaataagcagaaaatgaattgggtaagacttgcagaacatggacgtattccaacagatgttaaatatatgaatccgagaatatcctttgacggattgaactggtggatcagtgtatgtgtggaatttcctgattgcaaggaaacacttaatgatgatggagttggcatagacttaggaatcaaagatttggctgtctgctctgatgctgttaaatataagaacattaataagagtcagaaagtaaagaaactagaaaaacagaaacgcagattacagcgtagtatctctcgttcttacgagaagaataagaaaggggaaagttactgcaaaaccaataatgtaatcaaaaaggaaaaacttttattaaaacaaaatcacagattaacaaacatccgtaaaaactatttgaatcagaccatatctgagatcgtaaatcgaaaaccaagatttatctgtattgaagatctgaatgtcagcggaatgatgaaaaatagacatttatccaaagcagttcaggaacaaggatttttttggtttagaaaacagcttgaatacaaatgcggtgataaagggatccagcttattgtggctgatcggttttatccatcatcaaagctttgcagctgttgtggaaatatcaaaaaagatttgaaattatctgacagggaatatagatgtgagtgtgggaatataattgacagagatttccaggcatcaataaagcttaagggttatggagaacgatttgcaagctgaaactgaaacgttaatgcaaatatgtacggatacgttagtccggaatttacgcctatggagagtacaagaacttgtgagtagatagatatttatatcatcaaaagcatactcgttgaagtaggaatgaaacatagaagtttgtaactttttataagttttcagtaacggtatgaggaatgaaaatatgagtaatacagcgacgatttcgcagggacaggagattttagcactccaggatgaactgaccggtgcgctgatcggtcttgccagatcctgtggtaacaatccaaagacagaaaacacagatgagattatcatcgaaggtcttgtgcatacgattacgaacagcaacaccggggcagcagctttaaaagcgatgatcgaaaaagtaagagaagaaaaaaataccgtcgcaccggattgcgcagtctgtgcagcaccgtgtggcaatacctccgaatatgatgtgagcaatatctggaaacacgaaacagatgtgcgcggcgtggagactgcaatccttttcggaatccgggagatggcagctatcatttacccggcggtcattatggggaaaacagatgcggaagtgaacgaattttcctataaggcactctgcatgatcagttatggaatgagtaaagaggatctgttaccggttgtgcaggaactgggtgagatgaaccagaagtgcagagagcttctgggacaggtgtagcaagagaaaagtctgaaaaatgagatttcttgacagagaacaggggatttggtattgtttaaaggacggaaaaatctgacagacgagaaataaaccgatagaaaagaaatgaaataataggaagcgggttgcgtctggcaatccgcttcttttaaaattggaggttggacagtggcgtagcgagtgtaacgtagctatgcttttagattttaacgaaaaggaaaagagggcaaaaatggaactgagtatacttctgatggaacagattgcaaaattgtttattatgatctttatgggatatgcggtagtaaaaatgggattgttgaaagatgaagacagtaaagtactgtcaacattggtgctctatttgattgtaccatgtgtgattctgaatgcatttcaggtagagtatacgccggaaaaagtaagtggactggagctggcttgcattgcatcgttattgcttctttttatattacttccaattgtcaacctgattggaaaggttcttcatctgaatgaagtagaaacgatgtctatttattattccaattcagggaatctgatcgtaccacttgtggcatttatgcttggagataaatgggtattttatgcgtgtgtatttatgggacttcagaccatctttttctggacacactgcaaaaatgtacttagtcacgaaaaaggatttaatctgaagaaaatattttttaatatcaacatcattatgattatagtcgcgattgttttgttttttgcaaaaatccgtctgccggaaattgttacaggaacgcttagttcagtcggagcaatgattggaccggcaagtatgtttgtaattgggatgctgatcggtggaatggatttaaagaaagtattgacgaataagaaagcatattttatttcgtttatgcgactgatcgtgattccgcttattgcgttgtttatcctgaaggtaagtggtcttgtgggatggaataaagaaggagaagaaatccttttgattgtatttatggcggtaatttcgccggttgcttcaactgttacacaaatgtgtcaggtatatgacaatgattccagatatgccagtacgatcagtgtgctgactacacttggagcgattgtgacgatgcctttgatggtactggtgttccagatggtgatgtaaaggaattaagcataaatatatagtagtagagatgagaaagaatgttcctggggatggggatgttctttttttatacctaaaaatagttggttttaggaaagaattatatggatataaataaaaactaaggaaaatgttacatagataatttaaaaggaaaagtgataaaaaagaatgaaattgttaaaaacatacaaaaaatacagtgttaaattgctaaatatgacaaaaataaataatggtatttacattttaaaaaccaggttgtatattataggaaaaggaactggtcatgacgacatgacatcataacaaaggaggaagaaaaatgaaaaaaagagtagtacaggcattgggatgtatacttgcaatgacgatggtagtaggaagtctgacagcatgcggaggaaaatctgagaaaaaagcagaaaaaaaagcaggaagcgatgtaaaggtcgcaattatatgttcagctgctggacagaatgataatggatataatcaatccgcagtagaaggcgcaaaaaaagctgctgacgaatttggtattgaatataaggttgttgagccgacaacaggtgtaccacaggcactggaatcattagctgatgatggatacaatgtaattttcaatctggaatatgactttgaagctttgatccagggaaccggtggagcgcaaccaattgcagaaatgtatccagatacaacatttgtatgtgtaaatgataatccgaatcaggatgaagacggaaatacaattcatgataatgtaatcagtgttctgtttgacgtacatcaggcatctttcgtagcaggtgcacttactacattggtaaatgaaaatgcagaaactttatttggtacagatggttataatttcacacctgcagataatggcggacgatccgtaggatttatcggaggaactaattcaaatggtatcacggtattctcttatggatatatcgaaggtatcaactatgaagctgaaaagctgggtgtaaattatgattactatgcaaaatatgatgcaggatttgctgattctgcaacaggaagtacagtagcaggaacatattataatcagggagcaaatattgtattctcagtagctggttctgtaggtgatggtgttgcatcaaaggcaaaagaagaaggaaagcttgcaattcaggtagatgctaacaaagatgatcagcagccaggatatgttctgacaagtgttattaaaaatacagaagtacctgtatatgacattgtaaaagaagcagtaaatggaaagattgataagatggatcgtgcacagacatattcattagcatcaggcgcagcttctattacagatctttcagaaatcagcaaacacatacaggatagcggaaaagacaaatgggaagaaatcaaaactgaaatcaaagatgtagaagacaagatttcagatggaacaattgtagtaacggatgcgcagagtggagaagaattcgatgcttctaaatgcccgaatgttacagtaaaatagttgttttgacagaaaggaagcagcaatatgaacagcatgatacagacggttgatctgaccaaaaagtttaacgattttgtcgcaaatgatcatattaatctggatgtaaaagaacaggagattaaatgtattgtaggtgaaaacggtgcaggaaaatctacaatgatgaatatgctctacggattgctgcagccaacaagcggaaaaatcctgatccgggggaaagaagttacactgaacagcccggttgatgcgattgcaaacgggatagggatggtgcaccagcattttaagctggtgccgtctcttaccgtatatgaaaatatactgttgggtgcggaaattacacagaaaaaaggcggaatgaaaactccgtttatcgatcagaaagaggaaattaaaagagttgagaaactgattcaggaaaatcatctggaattaaatgcaacagataagattgaagatatatctgtcggtggacgtcagagagtagaaattctgaagatgttatacagaaatgtagacatattgattctggatgagccgacagccgtacttacaccacaggaagttgatgaattgattgcaacgctcaaaaatctaaaagagcaaggaaaaacaatcattgttattacacacaaattaagggaagtaatggaactggcagacagtattactgtaataaaacagggaaaagttgttggaaatgtattaaagaaggacacaagtgaacgagaactggcacagatgatggtcggaagagatgttgttcttactgtaaataatgcacgaaaacaacaagttgaatcagagattatgtacaaagcagaaaatcttacgactgtgaatgactatggaaaagaagttgtatcagatatgtcatttgaagtgcataaaggtgagatccttggaatagccggtgttgaaggaaacggacagtcagagcttgtaaagcttatgactggtttgatggaatcgacgagaggaacagtattttttgacggtaaagatattacaaactggtggccggaaaaattaagaaaagcaggaattggaattattcctgaggacagatatgcacagggattgtgccgggaaatgacggtttccgataactgtatagcaggatatcacggagaaaaagatgtttgtaaacgcggactttttaataagaaaataatcaatgccaaaagagataaatatattaaagaatttgatatccgtcttggtgatgtgaatggcaatataggcaatttgtcaggaggaaatgcacagaaagttatcattgcaagagagctttctgcaaatcccaaacttctgattgcctgccagccaacgcgaggcgttgatatcggatctattgaattcatacataaacagattctgaaattcagggatgcaggaaatactgttatcctgatttcaagtgagctttcagaaattatgagtttatctgatcgggtaattgttatgtataaaggtaagatttcaggtgaagtatcaccgaaagaagtgtctatggctgccatgggacttttgatggctggaattggaaaggaggaacaggatcatgaaaaagaaagatagtattataaaaggaatcgtcaattctgtacttccggtaattcttgcatttgcatttggagcaattattattgcggcgatcggggaaagtccgctggaaacatacggggtactgatcagaaaatcacttttaacagagaaaggatttatgaatacattgcattatgcatcacctctcattctgacagggcttgcaattgcaattacattcaaagcaaatctgtataacatgggtgtggaaggccagatgcttttaggaggattctttgcaggaatcactggagcatatcttaatatttccaatccatttataagcaaactgatctgctttttagttgcaattgtctgtggaatgttatttgcgctgattccggcaattttaaaagcgaaatgtaatgtaaatgagatggttgtgactttgatgttaaactatgcagtttcaaagactctggaatttttaacaactggtgtattcaaagataagagtgcaggttatgtggctacacctacgattaaagagaatgtgatgttcaaaagatttggagcatcaagaatgaccatgttttttgtgattgcaatgattattctggtaattatgtattttgttatgaagaaatcaaaactgggatatgaaattacagctattggaaaaaatccggaatttgcagaagcaacaggtatgaatgtcggaaagaaaatcattattatgatgttgataagtggtgcgctttctggtgtggctggagcaggatggatgttaagtgatcagtttaaatatacactgacattttctgcaaaccctggtcttggatgggatggtatgctgattgctctgctcggtggacattcgccaattggaattttgatcgcggcaatcttttatgctgcattaaaaaccggtagtgacagcatcaatatgtatactgcagttccgaaagaaatcgttgcaattattcagggaatgatcattctgttcctggcagttaagtttattggtgataaaacaagcgtatttagtcgttttaaaaaggcgaaaaaggaggatgcataatggaattattaaatagtattttgtatgacacagtataccatagtgctcctattattctatgcgtgatcggtggaatatttgcatataaagcaaatgtattgaatatcgcactggaaggaatgatgctgaatggagcatttatttcagtgttagtcgagtatctgacaggaagtgtggctctggcagtgattgccgcaatcgtaacgactttattgtggggacttgtattttcatttttaggaattacttgtaatggtaatgttattgttatcggtcttggaattaacttgattgttccagcgattgcaaaatttgtactgaaagttatggagcttgctaatatcagtcttcaagatgtaggagttgcagattttaagatcaatataccgggcatcaagagtattccgctgattggtggaatcgtaagtggtcatccggttattacatatctggcatttattggaattgcggcagcagctattctgatgtacaaaacaaaatttggaatctatgtcagagttgttggtgaaaatgaagattcagcgatcagtcttggactgaaaacacagaaatacaaatatattgctgttctgattggagcattttgctgtgcattagccggaatcaatttatcaatggagagaatggcaatgtttacaagtgatatgacagcaggacgaggttttatcgcaattgcagcaatttattgtggacaggggaaaccggtacagtcttcactctatgcaatcttattcggtgttgcaagatctcttgcagtcaatttaagtgtatatgcaggaccggcagcaggaatgttcgatacaattccatatatcatcatggtagcggtgcttgcagttgtttcatttatgaaatttaaggatgttaaggtaagaggatacaagtttgactaaggggggaggaaaatggcaaagacagcattgattattgtggacatggttcgcgattttacggatccggaaggtctggtattttatcctgagaatcaaaagattcttccacggattaaaaaggttctggatgaaagccggaaacatgaactgctgattgtttttttacagcactgtaacagaaaagataaagtagataaaaaagcacagtccatgagaccaaattgtatagaagggacttttggaattgaaattgatccaatgttggaagttgatgaaaagaaagattatgtcatccgaaagagaaggtacagtggattcttcggcacagacctggatctggtattgcgggaaaatgaagtggaaaatgtagtcgttgttggaacgaaaacaaactgctgcattcgggcaacggtgacagatgcattttatctgaattacaacccatatgttatccgggaatgtgtggcaacgaattcagaaacagttaatgaagttcatctgacagatattgataagtatctgggaaaagtcatcgatatgaatacattcagcaagatgctggaagagggacagttgtaggaggcacggataatgaaagtagatgttctgacaagcggctatgtaagtatggatcacattataaaaatagcaacacctgccaaagtgggatttacatcactggttacaaataaatccaattcaaaaattttttacggaggctgttctgtaaatattgcctatgcactttgccggcttgggatgaaggcaatgccagttttaagagtaggcggagattatgaaagtaatggttttaaaaagtttctggaagaaggaaatgtaccacaggatgggattacacaaatagcagaggaagcaaccagtgtatgttatttgttacaggataataataacgatcatattaccatattttatcctggagcaatggatggaagatatgcacagaaaatgaaagacagcttgtttgaaacggcaaagctgggagtgataaccgttgcatcaagaccagacaatgaagagttttttgcaaaatgtaaaaagcatcatgtaccggtagtttttggaatgaaagatgattttgatgcatttccagaaccatttttgaaacagttgttaacagaaagcaaaatcattttcacaaatgaagtagaatgtgaaattattgaaaagcttttcggactaaatacgattacagagctgtttaaaattggaaaagcagatattattgtgacaactctgggaaaagacggaagcatttgttatgtgcgggaagacggaaaaatacggaaagaagagattggaatttgtcaagtggaacaggtagtagatgcaactggatcgggagatgcttacatggcaggatttgtttatggatatttacatggatattctccggcagactgctgtaggcttggaagtgtattatcttactttgttttacaggcagaagggtgctgtacaaatgcgccaacagaacaggaattattacagaaatttgaaacattacgctgaaaggggaaatgcagatgagtacattatatatgggagcaagcgaagaaacggttgcgaaatatgtacttttttcgggagatccatggagagtagaagttgtaaaaaagtatttggataaccccaaaaaagttgcattcatgagagagttcaatacatatacaggaacctataaaggagtagagattacagtaacgtcgacgggaatcggggcaccgtccgcagcgattgcgatggaagagatgtatgagtctggaatgcaggtcgctgtaagaatggggacagtaatgtctatgcaggatgatatgctgggacattttatgattccgattgccgcaatgaggcgagaaggaaccagtcagagttatgtagatttgagttatcctgcagtcgcagatgttgagcttgttaatgtgatgaatgaaacagttcagcagatgggaaaacgttatctgaatggattgaactgtacgatggatggtttctacagttgcatgcatgattccaagttttctttggaatgtggacgggatatgtcaaagacatttgaagaggttaagaaacttggagtaacaggaattgacatggaatcctcctgtattttgacgctgggacgtttgatgggagttaagacctgtattttaacagttgttacagtgcttgaaaatttgaaggaaactttaaaaggacaggatcgggtggatgcagaggatctgctttgcagaacagcattggaaggaatttataattatcatataaaaagagaggatggtaaaaatgagtaaagaaatacttaccttaaattcacagacagtaatcggaatggtgcattgtcttcctcttccgacgacagcaggatttgatggagattatcagcgaattattgatcgtgcagttcaggatgcagttacgcttgaaaaagcaggggtagatgctgttattgtagaaaatatgggggatacacctttttccgcttttttaaataaagcacaggtagcggcgcttacagctgcagcatatgctgtgaaacaggcagttcagattccagtaggacttgacgcagcgtttaatgactgtgaagcagatattgcgattgctgcaatggtaggagcatcctttatcagagttccagtatttgtggatacagtattgtttacagatggaattattcagccatgtgcaaagaaatgtatggaatatcgcaagatgatgggacaggaaaatgttaaaattcttgccgatgtgcaggtaaaacatgcgcatatgttaagagaacatattacgattgagcagtcagcaaaagatgctgcatcaaacggagcagacggaattattgttacaggtacacaggttggagaagagacaccactggatctgattaagagagtgaaaaatgttgtaaatcttccggtgtttgcaggaagtggtgtaaatgcagaaaatattcatgatcagcttcagacagcagatggtgcgattatcggttccagcttgaaagagggaggaattttaacaaatccaatctcttatgaactggttaagaaagtattagatggattgaaatagagaaaggcaggaagataaaaatgatgcgaccaatgaaacttgcaggatcagaattgatgtttggagaaggaagtcttgcatatattaagacaattaaagcaaaaaaagtcagtattgttattggcggacatagcatggaaaagagtggaatgctggcaaaggtagaaggatattttaaagaaaccggtgctgaaacaatggttatcagaggcgtagaaccagatccgtcttttgaaactgtactcagaggaagaaatgaaatgctggaatttgaaccagatctgattgtcggacttggcggtggatcagcaatggatgctgcaaaagcaatgtggatcttttatgaacatccggaactgactcagatggaagatattcttccaccgaatgaatttccgaaattacgaggtaaagcaagaatgtgttgtattccttcaacaagtggaacagcgagtgaagtttcacgttctatcgtaatttcagataatgaaaaaggattaaagcatggtgttggaaatatggaaatgatgccggatatcgcaatctgtgatccggaagtaacaatgtctatgccggctaagattaccgcagagacaggaatggatgcgcttacccatgcactggaagcacttgcttcaaaccgtgcaaattatctgtcagatattcttgcaagccaggcagcccaggatattatggaaactttaccgactgcatatgagaatggcaatgatataaaagcaagagagactatggtacaggcatctatggtagctggaattgcatttaccaatgtatcgcttggaattgtacattctatggcgcatacaatcggtggtattttccatgtatcacatggtctggcagacgccattattttgccgtacatcatcagatataatgagcagaatgaaactgcgaaagaagtttatgcaaaatttgcaaagagaatcggagcagaaaatcttcatgaagcagtagaagcgttaaatgaaaagttaaatattccaaaatgctttaaagagatcattccggatgaagaaaaatatatggaaaaactggatgagatggctccgcttgcaaaagctgatggatgcacaaaaacaaatccggttattccggaaattgacgaatttaaagaattatttatcaaggtgtacagaggagaataaaaatggagattatttgttatttatcaaatggatatcctacaattgaagcaagttataatatggcagtagaatatgcagatgcaggatgcagaatgatggaagtggattttccatccagaaatccatacctggagagtgattatattgcaggaagaatgaaaaaagcactggaggcttgcgatgattatgaaaaatatatggattcaattgttgccattcagaagagacttccagatgtgaagattctggttctggcatatgaaaatacagttgaagagattggtgtagacagatttattgagttctgcctgacaaataatttaaaagatattttgcttgttggcttaaaagatgatattattaaaaataagataattgcagcggggcttcaggtatcttgttatgtacagttccatttaccgaaagaagaagtggaaatggcaaaacaatcaaatggatttgtatatttacaggcgaagccgtatgatacacagcaaaaaaatgaggaatatcctacattaaaagattgtgtagagtatttaagaagctgtggaattgaaagacctatttattgtggggtaggcgttcatgcaccagaagatgtaagactagtaagagaggcaggcggggatgcagcgttcgttggcagtacaattctaaaacttcatgaaaatattcctgcaatgaaagaaaagatcagggaatttaaagctatgtgttaacacttggaatattctgtgatcaaaaaaggtgagatggggtgaaggagatgttcgacgaaaagttacctaaatattatcttgtgaagaaggcaatcgtagagaatattgataatgaagtttacgattcaaaggagccgattccgagcgaaagagaattgatggagacttatcaggtcagcagaattacgatccggaaagcgattgatgaattggtcacagaaggatatttgtacaaagtccagggaaaaggaacctatgtaaagacggatgaaggaagtaacaatcttttttcaattacgagttgtacggaagatgtattaaagctgggactgacaccaagtaaaaaagttgttgtttcagagctggttgatgcgaatgtaaagagagcaaaagcacttgagattacaaccagtgataatgtttatatgataggaagaatcttatatgcagataaagagccgctaaactatacgctgacttttctgccggaaaagatttttccgggtttatcaaagtatgatttgaaaaaggaatccctttatcagatcataacagaagtttatggtgttaagataacaaaggcaagaagaacgattgaggcgatcggggcacaggatgaaattgccgagtatttggacatcgaggaaggaacaccgattattctgtttcgttgtattacatatggcattgtgaatggaagagaaattccgatcgagaatttcaaatgctattatcgaacagataaatttaaattctatattgatcaggtgagataagaaaagcaaaggggaacggtattttttatgagatatcgttctccttttatgcaaaagagaagatttatacgtcgttgtaaatatgtagtctggtttgaaattttatatttataagaaaaatgttacaaatactatttgaaaaacaaagaaaaatgtggcaaacaggtatagataaaggtggaaaaatgttacaaatatatggaaagcatataaaatcgcggagatttctatatgaaatgaaaatgttggcgacttttcaaatttccacttgacattcccccactttcagcataacattttgtagaatgtttattgttatgaaaagtggacttacagaaaaggggaaaatcacagatgaaaaattggaatcaggttaagctggtgccggaatttaatgaacagggtgtagcctgttataaactggccggcgggaactatgtaaatgaatattatgttgtatcggaagcagagacaagaaagcttctgaatacaccggagatcgtcggatatgaggtatatgactgcctgattccttctacatctcagatgctttactattttaaggaacagaagaaagtgacaactgcaaatattctttctatcttgagaggagcgttgaactatccgttggaggaaagctgctacagagagcacatccgtgtacacgatatcagtttcttatccagtgaacgtgtatttgcggatgaagagattgcagggcttgaaatcaaatatagtaagcttaccatggttccggacagcacactgatgatcggagatatcattgcaagtggggagactctgatccactgcctgcgctatgtgacagatttttacaggaagaacggagcaaagcttcgcaatattatcattttcacaattggtggaacaaagggaattgagattcttgagaatcttaccagagagatccgtgagttctggccggaatttgaagggttcattaccgtgtattatgaaggaattttcagtacttatcaggataaaggtgtgtcaggaatcaaccttccggatgtggacttctactggaaggacggaatcatcgcgccggagttcagaagagagacactttccatgtgcagtccgctttttgaaaaatgtatcatctacgatggcggggcaagacgctatgagattcatgagcatgtagaggaagttctggaattctgggaaggaatcaaagagagagcagataagatcgattttaaagaactgcttgatgaaaagattggatacccgacaccgatcagttatgaggactggatcgagaagaaccactatgagaagatccgtccgacagacactaagtggctgtaccgtcaggaacagggatatatcgagagtatgaaaaatattacattaaaagaactggcagatcagagaattaccgaattcaccgattctttgaagaaatatatgctataaaaagaatgaacttgttgatcacagagaatggaatgaggtaaaaaatgagcaaaaacacgaaaaatacaactgttgatattgactatgcggaccaggcagtcccgaaagagggcagaaaaggtttcctgaccatgtttatgatcatgctgggatttacatttttctcggcaagtatgtgggttgggcagcagatggcagcaggacttgatttctggggatttatcaagtcccttctccttggaggagcgatccttggtgtgtatacaggacttctgggatatgtaggtgcaaagaccggacttagcatggatcttctggcaaaaagagcgtttggagaaaaaggatcttatctttcttctgcaatgatcagcttcactcagatcggatggttcggtgtgggtgttgcgatgtttgcaatcccggtatcaggagaacttctcggtggaagtaaggctgcgatgtgggctttggtattggttgcaggaggctgtatgaccgcttctgcatatttcggaattgattcccttacggtggtaagctatattgcagttccgctcgttgcgattcttggaacggtagcaatggtgatggcagttcgtcagggaaatggaacaatcgttgaccagtttgcagtatccagtggatctgtgaccgtgatcggtggagcgggtatggtagtcggttcctttgtatcaggcggaacggcaactccgaactttgcaagatttgcaaaggatgccaaatcaggtacaattgcaacggttgtagcattctttatcgggaattcgctgatgttcttttttggggcgattgcctatattttcgttggcggaaatgatatctttgaggttatgatccgtctgaatctgttctatatggcgattctggttctgggactcaatatctggacaaccaacgacaatgcgctgtattcagcaggtcttggactggcaaatattttccggcagaagaagaaaccgatggttctgatttcaggaattatcggaacacttctttctgtatggctgtattacaatttctgtaactggctgaacgtactgaactgtacccttccgccggtagggatcatcctggtgctctcgtactttataaataagaaggagtacgacagtgataaagtagaaatcaaaactgtgaactggtttgccgtgatcggtgtgatcgcaggtgcagtggtagcaaatcttgtgtcatggggaattgcttcgatcaatggtatggcagttgcagcggtctgctatgtggctggacaggtggtttgcaaaaatcgtgaagaagcggcagaaaatgcataaatgaatagcgtaaatgaacgggcagattcggggaacagagtctgcccgttgttatattatggagcaggattacgcataaggttatcagtctaaacaatattattaaaaaactgaccataagtcaataaacaaattgacttatggtcagttttgttgtatattggttttgtaaaataaatgaccggcagtcattaagagagaaagaataaaaagaaaagaggaataaagtatggtaaaggttggaaaaaagattgttaaattcagagtaccgatactgatactcagtattatccttttgattccggctgtgtgggggtatgtgaacaccaggatcaactatgatgtgctgacttatcttccggaagacattgagacaatgcagggacaagagatcatgacgaatgattttgggatcggggcattttcgatgctgatggtagacggcatggaagataaagagattgtgaagctgaaagaaaaggtagagaaggtagacggagtagagaatgtactctggtatgattcactggcggatatttcggttccgcagagcatgcttccgtcaaagctctatgacgagtacaacacagaagacggaacaatgatggcggtatttttcaaagacggaacttcatccgatgaaaccatgaaggcaattaccgagatccgtaagatcaccggagagcagtgcttcttaagtggaatgtctgcgattgtagaggacaccaaagagcttgccgaaaaggaaacaccactttatgtactgatcgcagtcgcactttctgcactggttctggcaattacgatggaatcgatttttgttccagtattgttccttttgagtatcggaatcgcaatcgtatataatcttggaacgaatgtattttttggagagatttcttatatcacgaaggcactggcagcggtacttcagctcggtgtcactatggactattctattttcctgatgcacagttatcaggagcagcaggtgcgctataacggagataaagagcgggcgatggcacacgcgatttcccagaccttttcatccgtaatcggaagttcagttacgacggttgccggatttatcgcactctgctttatgagctttacgcttggaaaagatatcggtatcgttatggcaaaaggtgttatcttcggagttctggtctgtgtaaccgttcttccgtccatgatcctgtgctgtgacaagctgatcgagaagacgaaacacaaaccgctgcttccggatattggaaggatttcggataaggtgacaaagcgttacgtgatttatgtagtagcatttgtgatccttctgtttccggcgatttacggaaacaatcacacaggtgtttactacaatctggacgagtcgttgccaaaggatcttccgagtgtcattgcgaacacgaaattaaaagaagattacaatatgaacaccacacatatgatcctggtggacagctcggttgcaggttctgatgtcaagaagatgtcacaggagattgaaaaagtagatggtgttaaatgggtacttggattggataacctggtcggctcaggtgttccggcagatatgctcccggaatctgtcaccggtatgctgaaaaatgacaagtaccagctgctgatggtaaattctacgtacaaagtagcaacggataaagtaaacaaacagattgagcagattgataagatcatggataaatatgataagggtgcaatgctggtaggagaaggaccattgacaaaagatttgatcaacattacagatacagactttaaacgcgtaagcgcagtgtctattggaatcgtatttgtgattattctgcttctgttcaaatcagttactattccggtgatcctggtcggtgtgatcgaatttgcgatctttgtgaatatgggtattccgttttacactggaacaaagctgccgtttgtggcatcaatcgtaatcggtacgatccagcttggcgcgactgtggattatgcgatcctgatgaccaccagatatcagagagagagaagccgcggtgcaggcaaatttgacgcgatcacaacagcgcataagttctctgcgcagtcgatcatcgtcagtgcgctcagcttctttgctgcaacgatcggtgtcggactttattccaatatcgatatgatcagttcactgtgtatcctgatggcgagaggtgcactgatcagtatggtggttgttgtgctgatccttccgtccttattcatggtatttgacaagattattgtaaagacgagcaaaggtttccgacctacaggcttgaaatcataaccacatcatagtataattttcttggattattatatgatacaaggaacggagaaaaagatctgtgcgtatcaaaagggctgatacaatcctgctatcataaaaggaataaggaggaatccactatgattaattggaacaatttggatacacttacatcatttaaagaactttcggaagtagaacgtgtcaatcttgcagaagtgatgtccggtgagaacggagcagaacgtgttaaggattacagcgttccgatgacagaggatcttacttacaattacgctgcaaaagcagtagatgataaagtacttgcagcacttgcaaagcttgcaaaagaagcgcagctgacagaaaagtacgcagcactctacaatggagaagtgatcaacacaggagaaaagagactggttcttcatcagctcacccgtggacagcttggagataaagtagaagctgacggagtagacaagcgagaattctatgttaagcagcagcagaggatcgcagattttgccaataaagtacatgccggcgagatcacaaatgcagcaggtgagaaattcacaacagtcgtacagatcggtatcggtggaagtgaccttggtcctcgcgcaatgtatcttgcacttgagaattgggctaagaagaacggcacattcaagatggaagccaaattcatcagcaatgttgacccggatgatgcagcagcagtactgaattcaattgatgtagcacattctatttttgttctggtatcaaagtcaggaacaactcttgagactcttaccaatgagtcatttgtaaaagatgccctgaagaatgcaggtctggatgcttccaagcatatgatcgctgttacaagcgagacatcaccacttgcaaagagcgatgattatcttgcagcattcttcatggatgattatatcggaggacgttactcatctacttcagcagtcggcggtgccgtactttcgctggcattcggaccggaagtatttgcacagttccttgcaggagcagcaaaggtagatgaagtttccaagaatgaagatttattgaagaacccggcaatgctggatgcgatgatcggtgtatacgagcgtaatgtactcggatatccggcaacagccgttctcccatattcacaggcactgagccgtttcccggcacatctgcagcagctggatatggaatccaatggtaaatcagttaaccgctttggcgagccagtagattacccgacaggtccggtgatcttcggagaaccaggaacaaacggacagcattccttctatcagcttctccaccagggaaccaacatcataccgctccagttcatcggcttcaagaacagccagatcggaaccgatgttgtgatccaggacagcacaagccagcagaagctctgtgcaaacgtagctgcacagatcgtagcatttgcatgcggtaaatcagacgagaaccgcaacaagaattttgaaggtggacgtccgtcaagtattatcatcggtaaagaactgacaccagagacactcggtgcacttcttgcacattttgagaataaggttatgttccagggatttgtatggaatgtgaacagcttcgaccaggaaggtgttcagcttgggaaagtacttgccaaacgtgtacttgcccatgagacagacggagcactgaaagtatacagtgatcttttagatatctaatcagaattaatgaaagagaccagagtcggtgcggatcctaagtatccgtaccggctttttgagttatttttataagggaaagagtgtgaatatgaaattagaaaattacgaggtgcatcttccgaattattcaattggagatgcaatttatgataagatcggtccggtctgtgaatcttatggaaaaacggtacttgtgatcggcggaaaaagggcacttgatgcggcttttgataagatcaaagcggcggtcgaccagacgaatctggagattattggaaaagaactttatgggaaagactgtacctatcagacggtagaaaagcttcgccggatgtcggtttatcagaaagcagatatggtatttggagtaggagggggcaaagcactggatacggtaaaatgtctgtgtattacagatgataagccggtgttcagcttcccgacaatcgcatccaactgttcggcatgtacatcggtgtcgatcatgtataacgaggatggtacatttctgaaaccaaatttcttcgtgcgtccggtcatgcatgcatttatcgatacagaaatcatagcaaaagcaccaagtcagtatatgtgggcaggaattggtgatacctatgcaaaatactatgaagcaacaatctcatcaagggatgaaagactggaacattttacctcacttggtgtagcagtcagtttgatgtgcaggaatccgcttctggaatatgggccgaaggcatttgcagaccataaaaagggactgtgtacatacgatgtagagcaggtggttctggcgatcgttgtgacaaccggaattgcatccattttccttacaaaagattttacaccggattataacagtggacttgcacatgcaattttttatgctctgacgaagtatccggtgatcgagcagcggcatctgcacggggaagtagttggatttggtgtgcttctggcacttcttgtagatggacaggaagaagaatttgagaaaatatatcagctgaatcgcgagataggtcttccggtgtccttgaaagaaattgagattacagaggatgaatggaaagaaagtatgggacatattccgaaaatgtcggatgtagcacattacccatataaggtaacccgggaaatgctggaagatgcaatgcagaaactgaaagaaagagtcagaaaggatcagagccatgaagaataagaaatccgcaacttcctctatgattcttggggtagcgtttgtctggtttacaacacatttcggaggtggatttgcctcgggtgcgcagatctacagttattatgtgcgttatggaatctggtgtcttctgatgccggttctggcaatgggatataatgctgtatttttcgcgtactgcctccggtttgcgagaaagcatgaggtatatgattaccggtcttataacaatgcgttttacgggaagtttgcaccggtattttccaatttgtttgaagtactgtatatttgtgtgatgtgcgtggctcccgcagttgcatttgcgacaggcggagcgaccttaagtaccctgaccggacttccgtatctgctgtgtacgttgattatcggcatatttatcttcgttgtggcagtatttggaacagacctggtgcgtaaggtggcttctgtcctgtctgtctgcattatcgcaggtcttctgatcgtgtatattccgaatatcatcgcaggtgcagggcagattgcagatacagcttcacggatgactgcaaatggcggatcctttgggaaagcactctattcagcatttatttacggaacattccagctggcaaatgtggctgtttttgtgcagcatgccaagagctttgaaaagccggatgacgcggtgcaaagtatgggaatcggatggatcatcaatgcacttatgatgatcatggttgtgcttgggattatgactgtttgtaccaagccggagatgagcgaggcgagcgtcccgacactttttatggtgcagtgcggtgttggaaaaggatttatgatgccgctgatttctgttttgatcattcttggagcggtatctacggcggttaatatggtggctgcaatggtgaaaagaatctgcagtggtcttaataaagtgaagaaagagacggaaacgggtaaaaaaagtaaaattggtacaaaggaaattgtggcagcatttatctgctgtgttgtagattttggaatcgcacagttcgggcttctgacactgatccagaaggcgtatagtgtgctggcgtatctggcgattccggtaatccttattccatatctgatccacatggcagtgaccagatttgatacgaagtaatgagagaataaagggaaaagaggacaaaagatgccaatcggtgttatagtaaatgtaagtatggtgatgccggttagttatctttggggtacttatattttaccattagtgaggtgatggaatggcaaagattacagtgtggtcaaagcagcatgaaaatgtctggaaagttcttcaggagaccggacgatatacggtaaagcgagagtatatcataaaggatctcaaagaacattcggagctggttctggatacttatgaatggctggtcaagaacggaccggactacgggaataaaccggcggatgtggaatttccggtatgggtatcattcaggcaggatgcaacgatgcttccggaaaaaggaagagtgatcttggaactggagatcgaagaatccctgattaccagagtgaatttcacaaaatggggaatgatcctcaactattcctatattccggcagacaaggcggatgaaaagcggcacaaagagcttctggaagcctatggagtcagcgacacgcaggcgtatatgtcgcagttctatccggagatcaaacgggagatccgggagagctggaagaggctttttgatgatgacatccagatcggaagtgatggatgttatggaaacatctgggaggtgcgaagagaatgggtgaaaaatgtaatacaataaccttatatgcatcacaggcagacccggtaatcgaagcaattgagcggaatggcgtgtgctattccaaagaggcgtatgtgcgggaaaaatatcaggagagtgcaaagattttcacaacagtctattcttggtttgtgcgtgagatggagaaatatgtgaagaagccggatggtgcggagtatccgtactgggcattccgtgaagcctataatgtggatcagtcgatgggcggcaacttcctgacactggaagtaccattggatgaagttctgctttttgatatgtatgactggaataagattctctgtctcaaatatattggggaagatgaaaaagatgagaagcagttccaggagcagctggagatgtatgggatcaaagagatggatgcggtgttgagtaatttttatccgttacagaaggagcagatcctgaaaagctggcaacgtctgacacggtatcatgaagaattggcacatggaaatacagagcttgtaagggatgtacaagcaggactttggagaataaaaaaggagtggatcagatagatgaaagtattggtatacagaaaatgcagcacctgtcagaaggcgctgaaatggctggaggcgcatgagattgcatttgaggaacgggcaatcgtggaggaaaatccaacctatgaagagctgaaggaatggcatgcgatgagtgggttcccgctgaaaaagttttttaatacaagtgggatgctttataagcagatgcagctgaaagacaagcttccgacgatgacggaagatgagcagataaagctgctggcgacagatggtatgttggtgaaaagaccgtttgtagttgggaacggatttgtactgaccgggtttaaagaaaaagaatgggaagaaaaattgttgaagtagtggggaagatgagtgctgtaaaaggtgctcatctttttattctgcctgtaaagaatgtgtaaaaagaattgaaagaagacggaacacttacgaaactgagtaagaaatggcttggacaggatacggctccggaagaggaccgatttgaaaaaacgataaattaaaaagaaaaataacgggtaactcaatgaaaagaggaacccgttattttttattcagattttttgattttatcagaccaaggagcaggacggccggaaaaataatggctgcgaaaatcccggttttcagactgccgccggcgtaggaagataccagacctgcaagcgtcggaccaccggaacatcccagatctccggcaagtgcaaggagggcaaacattgttgtgccgccacgtggaatagagacggatgcggtgctgaaaagtcccggccacataattccaacggagaatccgcaaagcgcacatcccaaaaggttcagcgcaggaaatggaaggatggaaatacataaataggaaaggatgcaaagaatgcagcttcctctcatgaacagatccagccggatcctgtctccgtattttccgtaaagcagccgggaagcccccatacaggctgcaaaggtaagaggaccggcaagatcgccgagtgttttggaaatgtgcaggcttgtctcggcaaaagtggatgcccattggctgactgcctgttcgctggcaccggcacaggtcatcataagcattaacatccagaagattttagatgtgcacaattctctgagagaaagtccctgttcaccttcttcatgaagggagtagattggtgcatttctgaagaggaaagtgttaaatattgggatgacagcccacataagtgcgaggattttccagtgcgatattccgaaaaaccagaaaaatgcggttgataacagaacaacgcccacatgcccccaacagtaaaaggaatgcaggagactcattgctttttctttgttatcagtagggcaggcttcaatgatcgggcttaccagtacttcgagaagtccaccgccgatcgcataaatgataactgcgattacaagtccggtataaggggaggaaaaaacttccggaagaacggtgagtaatatcagtcctgccgcagaaaggatatgcgcaattaaaatcgaaatgcggtatccgatcctgtcgatgaagaatgcggatagaagatcgacaaacagctgaatgataaagttgagtgtgatcaaaaaggtaattcgttctagtgaaatatggtaattattttggaaagtgacaaaaagaagaggaacaaaattatttacgatagcctgaacgatgtaaccaataaaacaagcgtagatggtctgcatacaatttgtgctttttttcatttcttaaaagctcctttcaaaatagcactatatcatattggaggggtggatgtcttgacgaatatcgcagaaacatagtacaatatctccaaaacacaaaaggtataatgaaaatgcaaataacagagataataacagatgaaacactgagggaaatacgtgaacacggaacgccggagtttccttttgaatattatctggatgatatcgatgaaattggtcagggttatgtcgaatggcactggcataatgagattgaatgggcatgggttgaatctggaaaagtaatctgcaggattggaaatgaaaagattatccttgaagcgggggaggggatttttataaacagcagagtgatccaccgatttgaaacaccgggtggtgcgcttatgccaaatatcctgcacgctccagagctgcttgctgcgcgggaaagtgcaatttatcaaaaatatgttagtcctgtaattacatatggtaaagaatatgtgattttggaaaaagaaaaaaatagtggtatattaagtctgctggatgagatatacaaagatgccggaaaggaaatgcttagaaaagaactgattatacagaacaagatcagcagattatgggatgaattgtttgaagaagttccggatattgtacagagagagtcccggaataagaatctccttttacagtcgcggctcagagagatgatgcagtttatagaaaaccattataaagaacgaatttctttggaaaggctggcagcggaagcgaatattagtaaaagtgaagcccttcgatgctttaagcgtggaatagggacgactccggtgaaatatttgatcgattacagactggagagggcaagagaattattgtgtaagacgaatgatacggttattcgggttgccgcagatgtgggaatagataatacaagttattttgtaagaatatttaagaaaatgtatgggatgacaccaggagcattccgggaagaagaaggactgaaaaaggctggagaaaaataacatactagaagaaattctccgaatttagttgactttttgatacatcatgatatcattacttcgtatggctgaagtgttcgggagggtggaacaactggctttgtaagaagaacaaaagagagaggttttgggaaaaggaaaatgaatgtgaaatacgattacgagagaattgtgcaggggatcctggacattggggaagctatgattagatgtggagcggagaacttccgtctgcaggacagtctgtaccgtatttgcagaagttatggatttgtaaagtatgatatttttgttataccaagcaatatccagattacggcagagacaccggaagggcagattattacacagatccgactggtagaaataggggaatgtgactttgacaagctggattatctgaataatctgtgccgtaaaatctgtaaagaaaagccggatgcaaaagaaatgagaagacagtttgaagaggtgatgggaagaccggaacagaagtggtacacccattatgcggccggtattttaggtggtaccggatttgcggtattctttggatgtgatataagggatgcgatcattgcggtgatcgtatcaattgtgatcgttgcagcagggaactggctggccgaacgtgagaagaacctgctggcatataacctgatcttatcgtttattgcagagatgatcattctgttatctgttaaatttggatttgcggatcatgaggagcggatcatgatcggaattgtcatgctcctgatcagtggactgagtacgacgaacggaatccgtgatctgcttcagaaagactttatctccggatcgatcaatatcatgaattccatgcttggtgcttccggaatcgcatttggtacggcgataccgatgattctttttggcggtgtagaggcggaaggatatatccttaccccgaatctgatcgtacagctgatttcctgtaccgcagcctgcgtgggatttgcactgtggtttaagatccggggcatgcaggtggtttactgtggaatcggagcattttttacatggctgatttatgcacttgtttatgaggcgcgtccaagtaacttccttgcaactacaattgcggcgacattcgttgcattctatgcatttattatgtcgcggataaataaagcaccatcaacaattttcctgacagcgtctgtattccctctgattcctggaccgaatctgtactatgtaatgtacgcatgcgtaagcgggaatatgcatatgctcctggaacagacgatcacactttttgcaacctgcgttgcaattgcatttggatttaactttgtagatattgcatcaagaactatcatgcgtagtatgaaggtagaatatcacattggaaaaagtgacagataaataaaaagtttcagccgcggatttcattctgcggctgaaattttagcctgtgtgccgggaatatgcctggatgagagcagattccggatgcacctggacagtccgaaggctttcgtaaaaaattatttaatttcttgactttatactttcggtatggtacactaacctagcgaatggaagtataggtcttttttttatgcctatttttaacaaagaaagtttcaggcgtgaagctttcacgacagcctcgcaagctgtcatgcaactaaaaattagaacataaaaagcgaggtggaagttgtgcgtacaagaattacactggaatgtacagaatgcaagcatcgtaactacaacatgacaaaggataagaagtctcatccggaacgcatggaaacaaagaaatactgtagattctgcaaatcacacacattacacaaagagacgaaatagtcgttgaagggaagtgaatgttatgggcgaatctaaagacaaagcgaagacaaaagagaagaaaactcctttcttcaaaggtctgaaagctgagtttaataagattatctggccagacaaaaccacacttaccaaacagacagctgcggtcgtagttgtttccgttatcttaggagcgattatcacgatctgtgatatcctggtaaaattcggggtagatttattagttagataagatactgataaatggtaatgcaggaaaggtgagtttatggcagaagcaaaatggtatgttgtgcatacctattcagggtatgaaaacaaggtaaaagccaacattgacaaaacgatcgagaaccgtcatctggaagatgagatccttgaggtccgtgttccgatgcaggaagttgtcgaattgaagaacggcgtacagaaagcgtctcagaaaaagatgtttccgggatatgttctgatccacatgatcatgaacgatgatacctggtatgtggtacgaaacacaagaggtgttacaggatttgtaggtcctggatccaaaccggttccgcttacagatgaagagatgacaccacttggtatccagaaagaagacatcgtggtagattttgaagaaggagatactgtgacagtaacaggcggagcctgggaaggaacagtcggcatgattcagactatcaatatggctaagcagagcctgacgatcaatgttgatttattcggccgcgaaacgccggtagaaatcagtttcgcagaagtcaaaaaaatgtaactttatgcgcagtgcataatgaacacgtgggagggaaatccccgcaaataccacaaggaggtactttaaaatggcaaaaaaagtttcaggttatatcaaattacagattccagctggaaaggctactccggctccaccggttggtcctgctcttggacagcacggtgtaaatatcgttgaatttacaaaacagttcaacgcaaagacagctgatcagggagatctgatcattcctgtagtaattacagtttacagtgacagaagtttcagcttcgttacaaagactcctccggcagcagttcttattaagaaagcctgcaaccttaaatctggttcaggtgttccgaacaagacaaaagttgctaagattacaaaagctcaggtaaaggaaatcgcagaacttaagatgccagacctgaacgctgcatccgtagaaacagctatgagcatgatcgaaggaacatgccgcagcatgggtgtaactgtagtagaggactaattcagactgcataagcagaatgtaaggaaactgaaaaaatacgtgggagggaattcccgtaatcaccactaggaggtatttagaatgaaaagaggaaagaaatacgtagaagctgcaaagttaatcgacagagcaactctctatgatagagatgaagcgatcgcacttgttaagaagagcgcgacagctaaatttgatgaaacaatcgaagctcatatcagaacaggatgtgacggacgtcatgcagatcagcagatccgtggcgctgtagttcttccgcacggaactggtaaaaaggttcgtatccttgtatttgctaaggacgctaaagctgaagaagctaaagctgccggagcagattacgtaggtggagatgaactcattccgaagatccagaatgaaaactggttcgaattcgatgtagttgtagctacaccggatatgatgggtgttgttggacgtctcggacgtgtacttggaccaaaaggtttaatgccaaacccgaaggctggtacagtaacaatggacgttacaaaagctatcaacgaaatcaaagctggtaagattgagtacagattggacaagacaaatatcatccatgtaccggtaggaaaagcttctttcactgaagaacagcttgctgacaacttccagacgcttatcgatgcgattaacaaagctaaaccggcagcagtaaagggtcagtatcttaagagtgtgacacttacttctacaatgggacctggtgtaaaaatcaacccaatgaagcttgcttaatcagtattgaataaatgtaaataatagagacaccgtatgcggagtgatccgttacggtgtctttttgtgcaacatgaaatctaacaaacagtattctgtatacattgtgcattttttgacgaacaatgcatgaaaacattgaaaatcggggaaaataatgataacctatgcctgtgaaaaaaatatcaagcaattaaaaggaggcactttgtcatggttaatattcaaaaggcagcaattatcggatgcgggtttgtaggagcgtcctctgcgttcagcttacttcagaaagggatcttttccgaactggtactgatcgatgcgaataaagaaaaagcagaaggggaggcaatggacataagccacggtagaccatatgcgcatccgatgaaaatatatgcgggatcttatgatgatatcagtgattgttcactaatcatcattacagctggagcaaatcaaaaaccgggagagacaagactggatctggtacacaaaaatgtagcaattttcaaatcgattattccggaaatcacaaaacgcggatttgaaggaatcctgcttgttgtagcaaatccggtggatattctgacttatgcggcacttaagatttccggatatccgaaggaaagagtattcggaagcggaaccgttttggatactgcaagattccgctatctgttaagtgaacatcttcaggttgcgagccggagcgtacatgccaatatcatcggagagcatggagacagtgagcttgctgtatggagcggggcaaatgtagcgggaattccaatcaatgatttctgtgaacttcgcggacattatcagcatcaggaatctatggaaagaatttataagactgtgcgggacagtgcttatgatattatccagaaaaagggtgcaacctattatggtgtggcaatggcggttgcgagaattgcagaaagcattgttatgaatgaaaatgcggttcttccagtcacgagtctgatggagggagaatacggactggaaggactctgtatcagtgttccgaccatagtttcgcagaaaggtgcagaaaaagttcttgagattccactgagcgatgaagaaaaagaaaaattgctttcatctgcaaaagaattgaaggaagttctggatggtttggacttataatagaagaaactggatgaaattgaaaaaatgaaaaaatacacttgactttctggtaaacgtatgctatatttacgaagtaactgccgaagacagtaggtgccgtaaggcataagggtcaaaacgcctaccgaggaagacaagattcattagatttgaatttgtaaacctctgtgctttggcgcggaggttttttagcgcatgattgcgtgatatgaaagtccccgctgggaccgagactttctggcagttgaaaatactacaaggaggtgcaccattcgtggcaaaagttgaattaaaacaacctatcgtacaggcaatcgttgaagatctcacagatgctcagtcagcagttatcgttaactactgtggacttacagtagctcaggatactgaacttcgtaaacagctgagagaagcaggtgttatctacaaagtttgcaagaacacaatgatgaagagagcttttgaaggaacagatttcgcacagcttgacgaatatctggaaggaccgaacgctattgcaatttctaaagaagatgcaacagcaccggcaagaatcatctgcgatttcgctaagaaagcagaagctcttgaagtaaaagcaggtgtagttgaaggctcagtatatgatgcagctggtattcaggaactttctaagattccgtcaagagaagtactgctgtccaaattacttggaagcttacagtcacctattacaaaccttgctcgtgttcttaatcagatcgcagaacagggtgatgctccggcagaagctgaagcagaagcaccggcagcagagtaagctgtaccggaatcccatccgagtgtgggaacagtaagaggcgaaagagccaatcattaaaatcaaatggaggaaaataaaatggcaaaattaacaacagcagaatttattgaagctatcaaagaattatctgtacttgaattaaatgacttagttaaagcatgtgaagaagaatttggtgtatccgcagcagcaggtgttgtagtagcagcagctgcagaaggtggagcagcagcagaagaaaaagatgagttcgacgtagaacttgtttctgctggagcatctaaagttaaagttatcaaagttgttcgtgaaatcacaggacttggacttaaagaagctaaagaattagttgacggagcaccgaaggtagttaaagaaggcgtttctaaagctgaagctgaagaaatcaaaacaaaacttgaagctgaaggagcagaagttaaccttaagtaattttggttatcacactgtgaatgacaagagcgtatcgcgcaggatttcctgcagtgatacgctcttttgattttttgtacttttctgcggtatgcatacaatgatgacgaggattgcgagagtgcaaagcacggagcaatctggtatcaaagggaccgaaaataaattttgtcacttacattataaaatacaataaaaatacaattctttaaaaagttagacttgacaatcgggaaaaacctgtggtaaagtaaaaaatgcgctattgtggaaacgtatgccataagtgcgccctgaataaggcggaaataacccgaaaatttatcatataaggagtgaaacgtcaaatggagaaaaacagaattcgtcccatcacaaacggaaaaagtatgcgcatgagctattcccggcaaaaagaagtactccaaatgcctaatttgatcgaagttcagaccgactcttacaaatggttcctggatgaaggattaaaagaagtatttgatgatatttctccgattaccgattacagcggacatctgagcctggaatttgtcgactttacattgtgcacagatgaaaccaagtacacaatcgaggaatgtaaagaacgcgatgctacttatgctgcaccgcttaaagtgaaggtaagacttcacaacaaagagacagatgagatcaatgaacatgagatctttatgggtgatttaccgattatgacaagaaccggtacctttgtaatcaatggtgcggaacgtgttattgtcagccagctggtgcgttcacctggtatttattatggaattgcgcatgataaacttggtaaagaattatactcttgtaccgttatcccgaacaggggtgcatggcttgaatatgagacggactccaatgacgttttctatgtccgtgtggacagaacccgtaaggtgccgatcacagtcctgatccgtgcacttggtattggaacgaatgctgagattatcgatctttttggtgaagagccaaagattctcgcaagtttcacaaaggatacttcagagaactatcaggaaggtcttctcgaattatataagaagatccgtccgggtgaaccgcttgctgtagacagtgcagaaagtctgatcaccagcatgttctttgacccgagacgttatgaccttgcaaaggttggacgttataaatttaataagaagcttatgctcaagaaccgtatcacaggacatacgctggctgaagacgtagtaagcccgatgacaggtgaagtaattgcagaagcaggagctgtcgttgacagagaacttgcagatgccatccagaatgcagctgttccatatgtgtggatcgcaagagaagaaagtgaccgtaatatcaaagtactttctaatatgatggtagatctcaaagctgtatgtggaatcgatccggaagaagttggcgtaactgaactggtatactatccggtacttgctgaactcctggaagagacagccggagatatcgatgagctgaaagaagcaattcataagaatattcatgaactgattccgaagcatattacaaaagaagacattatggcgtctatcaattacaatatgcatcttgaatatggaatcggtaaagatgatgatattgaccacttgggtaacagacgtatccgtgcggttggagaacttctccagaatcagtacagaatcggtctttcaagactggaaagagttgttcgtgaaagaatgacaacacaggatctggaaggcatttcgccgcagtcattgatcaatatcaagcctgtaactgctgctgttaaagagttcttcggatcatcacagctgtcacagttcatggatcagaataacccgcttggtgaactgactcacaagagacgtctttccgcacttggtcctggtggactttcccgtgaccgtgccggattcgaggttcgtgacgttcactactcacattacggaagaatgtgtccaatcgagacacctgaaggaccgaacatcggtctgatcaactctcttgcatgttatgcaagaatcaatgagtacggatttatagaagcaccgtaccgtaagattgacaaaacagatccgcagaatccggttgtaaccgaagaggtagtatatatgactgcggatgaagaagataattatcatgtagcacaggcgaatgagcctctggatgaggaaggacatttcattcataagaatgtatctggtcgttaccgtgatgagactcaggaatacgagaaaagaatgtttgattacatggacgtatctccgaagatggtattctctgttgctacagcactgattccgttcctgcagaacgatgatgcgaaccgtgcgctgatgggatccaacatgcagcgtcaggcagtaccgcttcttactacagaagctccggtagtcggaacaggtatggaagtaaaatctgctgtcgactcaggtgtatgtgtcgttgcagaagaaggtggtattgttgagagatcaacatctaccgaaatcacaattaaacaggatgacaagacaaaaaagacttataagctgacaaaattcctgcgaagcaaccagagcaactgctacaaccagagaccgatcgttgtcaaaggtgaaagagtggaaaagggacaggtgattgcagacggaccttctacatccaatggtgagatggctcttggtaagaacccgttgatcggattcatgacctgggaaggttacaactacgaggatgctgtacttcttagtgaacgtcttgtacagaatgatgtttacacatctgttcatatcgaagaatatgaagcagaagcccgtgatacaaagctcggaccagaagaaattacacgcgatattccaggcgtaggtgatgatgcactgaaagatctggatgagagaggtattatccgtatcggtgctgaggttcgtgcaggagatattcttgtcggcaaagttactccgaagggagagacagaactgacagcagaggaaagacttcttcgtgcaatctttggagaaaaagctcgtgaagtaagagatacttctctgaaagtacctcatggtgaatacggtatcgttgtagatgcaaaagtatttacaagagaaaatggagatgaactttcaccgggagttaaccaggcagtccgtatctacatcgcacagaagagaaagatctctgtaggtgataagatggccggacgtcatggtaacaagggtgttgtttcccgtgtacttcctgtagaagatatgccgttccttccgaacggacgtccgcttgacatcgtgctgaacccactgggtgtaccatcacgtatgaacatcggacaggtactggagatccacctttctctggctgctaaagcacttggattcaacatcgcaacaccagtatttgatggtgcaaacgaggttgatattatggataccctggatctggcgaacgattatgttaacctgtcctgggaagaatttgaagcaagacataaagaagaacttcttccggaagttatggattatctgtatgagaacagagaccacagagcactgtggaaaggcgttccgctttcaagagacggtaaagtaagactgagagacggtcgtaccggagaatatttcgacagcccggtaacaatcggacacatgcattatctgaaactgcatcacctcgttgatgataagatccatgcacgttcaaccggtccttattcactggtaacacagcagccacttggtggtaaagcacagttcggtggacagcgtttcggagagatggaggtttgggcactggaagcttacggtgcatcttatactctgcaggaaatcctgacagttaaatccgatgatgtggttggtcgtgtgaagacatacgaagcaatcatcaaaggtgaaaatattcctgaaccgggaattccggaatccttcaaggtacttcttaaagaacttcagtcactcggtctggatgtacgtgtcctggatgagaacaatgaagaagttcagatcatggaaagtgtagattacggtgatacaaacctgaatcacattattgaaggagacagacgctacaataacgacgaagattacggcaaacacggatacagcaagcaggaattctcagaaggagaactggttgatgtagaagatgagccggaggaagatgacagcttcgacgattttgatggcgatatgaacgatgattttgatgacgacatggatttagaataggaggatgccgagaatgacagaaacaaaaaaagaaccaacgtatcaaccgatttcatttgatgcgattaaaataggtctggcatctccggaaaagattctggaatggtcaagaggtgaagttacaaagccggagacaatcaactacagaacactgaagccggaaagagacggtctgttctgtgagaaaatcttcggacctagcaaagactgggaatgccactgtggtaaatacaaaaagatccgttataaaggtgttgtatgcgaccgctgtggtgtagaagtaacaaaagcaactgtgcgacgtgaacgtatgggtcacatcgcacttgcagcaccggtttctcatatctggtatttcaaaggtattccgagccgtatgggactgatcctggatctttcaccgagaactctggaaaaagtactgtatttcgcttcttatatcgtacttgataagggagagacagatctctcttacaagcaggttctttcagaagcagaataccaggaagcaagagagaactggggcaatggtttccgcgtaggaatgggagcagaagcgatcaaagaacttcttgaagcgatcgatcttgaaaaagattatgctgaactgcaggcaggacttgaaggtgctaccggacagaagagagcaagaatcgttaagagacttgaagtagtagaagctttccgcgaatcaggaaataaaccggaatggatgatcatgactgcaatcccggtaattccgccggatctgcgtccgatggtacagctggatggtggacgttttgcaacatctgacctgaatgatctgtacagaagaattatcaacagaaataaccgtctgagaagactccttgaattgggagctccggacattatcgttagaaacgaaaagagaatgctgcaggaagctgtagatgctctgatcgacaatggacgtcgtggacgtccggtaacaggtcctggaaacagagcactgaaatccctttctgatatgttgaaaggtaaatcaggacgtttccgtcagaacctgctcggaaaacgtgttgactactcaggacgttccgttatcgttgtaggaccggaactgaagatctatcagtgcggtcttccgaaagaaatggcaatcgagctgttcaagccgtttgttatgaaagaacttgttgagagcggagctgctcacaatattaagaatgctaagaaaatggtagagcgtcttcagccggaagtatgggatgtgcttgaagatgtaatcaaagagcatccggttatgctgaaccgtgctcctacacttcaccgtcttggtatccaggcatttgaaccgattctggtagaaggtaaagcaattaagcttcatccactggtatgtaccgcattcaatgccgatttcgatggtgaccagatggcggttcatcttccgctttctgtagaagctcaggctgagtgccgtttccttctgctttcaccaaacaaccttctgaaaccgtctgatggtggtccggtagctgttccttcacaggatatggttcttggtatctactatctgacgcaggaaagaccgggagccaagggagaaggaaaagtattcaagagtgtgaatgaagcaattcttgcttatgaaaacggagttgtaactcttcactcaagaatcaaagtacgtgtgacaaagacgatgccggatggaacaaagaagaccggcacagtagagtctacacttggacgtttcatcttcaacgaaatcattccgcaggatcttggttttgttgatcgtgaaaaagaaggaaatgaactggttcttgaagtggatttccatgtaggaaagaaacagctgaaacagattcttgaaaaagttattaacacacatggtgcgtcagctacagctgaagtacttgaccatgtaaaatcaatgggatacaagctctctacaagagcagctatgactgtatctatttcagatatgactgtaccgccacagaaaccggaactgatcgcaagagcacagtcaacggttgataagatcacacgtaacttcaaacgtggtcttattacagaagaagagcgttacaaagaggttgtagaaacctggaaagaaacagatgatgagcttacagaagcccttcttacaggacttgataaatacaacaatatcttcatgatggcagattccggagcccgtggatctgacaaacagatcaaacagcttgcaggtatgcgtggacttatggcggatacaaccggtcatacgatcgaactgccaatcaagtcaaacttccgtgaaggtctggacgtactggaatacttcatgtctgcgcatggagctcgaaaaggtatgtcagatactgcccttcgtacagccgattcaggatacctgacaagacgtcttgttgacgtatcacaggatctgatcatccgtgaggttgactgtgtaagcaaagatgccgaaattccgggaatgtatctgcatgcatttatggatggaaatgaagaaatcgaaagtcttcaggaacgtattacaggaagatattcatgctatacaatctgtgacaaagatggcaatgttcttgtaaaggcaaaccacatgatcacaccaaaacgtgcagaaaagattatgaaatatggtgtggatgaaaatggaaattcaccgcttaagaaagtgaaagtccgtacaatcctgacctgtaaatcacacattggtatctgtgcgaaatgttatggtgccaatatggcaacaggtgaaccggtacaggttggtgaagctgtcggtattatcgcagctcagtcaatcggtgaacctggtacacagctgaccatgcgtactttccatagtggtggtgtagccggtggagatatcacacagggtcttcctcgtgtcgaagaactttttgaagcaagaaagccgaaaggtcttgctatcatcacagaaatcgcaggtgttgcaaacctgaacgatacaaagaagaagcgtgaaatcatcgttaccaatcagcagacaggtgagacaaagacttatctgattccttatggatcacgtattaaagtacaggatggagctgttctggaagccggtgacgagcttacagaaggtagcgtgaacccacatgaccttcttaagatcaaaggtcttcgtgctgcacaggactacatgcttcaggaagtacagagagtataccgtttgcagggtgtagaaatcaatgataagcatatcgaagttatcgttcgtcagatgctgaagaagatccgaatcgaagaaagaggggatactgaattccttccgggaacaatggtggatgtccttgagttcaacgatgtaaatgaacagatggtaacagaaggtaaagaacctgcaacaggagaacagatcatgcttggtattacaaaggcatccctggcaacagattccttcctgtcagctgcatctttccaggagacaaccaaggttctgactgaggctgctatcaaaggtaaggttgaccacctgatcggtctgaaagagaacgtcattatcggtaaactgattccggcaggaacaggtatgagaaaataccgtgacgttaaacttgatacaggtcttggtatggatatggacgacgaaatcagttttgatgattttgatatggatgatgatactgagtctgaagtatcggcagagacagcagaaactgttgaaaccgaagaaaatgctgacgaaacagttacagttgaagaataggctttatatgctaagagaggcagatacgttgaatggcgtgtctgcttttcttgctttaaagacatgaaaaacaaaaatatttgaaaaataattccgattctttaacactttacaaaaataaagggttgcaaaatatgaaaaaatacagtagcatataaataatcaatcgaaaatcagggggtgtgatatgctggatttagctcatattggtgaacggatcagagaatgcagaaaaaagaaaatgatgacaatccgggttttgggagaatatacaggactttcagcgggctatctgagtatgctggaacagaataagacatctccgaatgtggacagtcttgcgcgaatttgtgaagcactggatattgatatacagtatgcactggaaggggaaatgccgggaaagacggttatacacagagaagaaatgagtaagcatctttatccggaagaaaatatgacggttgaggttgcagactttggtcagggagaatcgatttttgaatatattacgattgaaccgggagaatctgcgaaaaaagaagaatatcgtcatgtcttttcggaaatgtgtatggtgataaaaggaactctgaatgtagaggtggaaggaaaaatttgcagtttacatccgggagacagtgtatatataaagagcagagagcgtcatagtatttccaatcccggaaaagaaccttgtgtcagtatatgggtatatcaccgggatgtaccaagacggtttgaaaggaatgaaaataaaattgtgaaataaatagcattcctcttgacaatcttagagtatggttctataataaggaaaattacacatatgaataaatattcatctaagtgaatttacaaaattgaactgttaaaacggagtttcttcgaaattcacgcaactctgaagacagtgttatttacgaaagtgtataaagactgattttatacatacaatacggacaatctaataattaaacatagacgtcatagcgtgaaactatgacctttgaaagaagacaaggacgtcatgatgcaaatcatggcgttcttttgtttacactactagactgtggtctagtaaagtattacattgtcgcagagggacggacatatctggtaaatataccgtatcagaagaacaaaagtacatgagaggagaacaaaaatggacagattaactcaattgcgagagtacatggaaaaagaaagactggatgcgttttatattgcaaagccggcgaatgtacgttgtatcagcggatttacgggggaagactcattcctttttatcacaaaggcgaatcagtattttatcactgatgcaagatacacagagcaggcatcttatgaatgtccggattacgaacttgtaaactggcgaatcaattttggctgcagcatggggaaagctgttgcatattgcgcagacaaagatggagttaaaacaattggatttgaacaggatcatctgacatttgaaaaatggaactctatgcaggctgaactcagtgctgagatggttccgacgctgaacgtaatcgaaggcttccgcgcgatcaagacgccggaagagatcaagaaccttaccgttgcctgcgatatcgcatccagagcatttgaaaaaattataaaagacatccgtccgggtgtgacagaaaaagaaatcgcatccagacttgcacattacatggtaatggaaggtgcagataccaaaccgtacggtggaatcgttatttcaggagcaaagagctctctgcttcacgggattccggacagtaagccaatcgaatacggagatttcgtattgatggattatggatgccagtacaaaggctatctttcagatatgacaagaacagtagttgtcggcaaggcagacgccaaacagagagaagtgtatgatctctgccgtcgtatgacagaagatacagaagcatctgtaagagccggtgtgacaggaacttcctgctatgaagcttcacttgaagcaatcaaagatacagaataccttccgtataattatacaggaatcggtcatggagttgggctgttcgtccatgaacttccgaatatcggactgaactgtgagaatatcttacaggagaacagcataatgacagtagaaccaggactttatattccgggttggggtggtgtcagacttgaggatcagggcatcatcacaaaagacggatatgaaaacctgatcagtgctacacatgagctaatagaattataaatgaaaaaggaggacaacatttatgaaaaagaaattattagcagctttacttgctacagcaatgacagtaacaatgtttgctggctgtggtacaccgggatccaaagattccaagaaagatgacagcagtgcttcatcaggaaagaagagaattacttacacacttcgtgaagaccttccttctatggatccacagaacagtaactctatctcatgtgcaacagcagaaatctgcacctatgcgatgctgacacgtaacgtggaaggcgaaatcaaaccagatgcagctgaaagctgggatatttcagatgacggacttacttacacattccaccttcgtgatggactgaaatggtctgacggagaagatgtaaaagcaggcgattatgtttatggtatccagagacttatggatccagaaatggcaagcgattacgcattcatcggatatatcctcaaaaacggtgcagaagtaaatagcggttctgtgcctgtcgatgaacttggcgtatctgcaccagatgacaagacagttgttatcgaacttgcacatccggctacatacttccttagtatggctgctatggcaacattcggtcctacaagaaaagattatgtagaaaaatacggaaaagaatatgcagctgatccggaaaaatctgtttataacggaccgttcaagatgacagagtggaaacacggcgatgaaatgatcctttctaagaatgaaaattactgggatgcagacagcatcaagcttgatgaaatctgcgtaaagacagttgcagatgctaagacagcggttgctatgtgggaacagggcgaagttgatatcacagttgtacctactgaaatgacagatcagtatacagaaaatactgaattctactatacaggtgcagatgattacatcatgctcaacatgtcagaagacagaccgcttgctaacaagaacctgagatttgctttgaactatgcaatcaacagaacagaatacaacaagctggttaacaatgacgtatatgacgttgcacagagacttgtacttccaaacgtgcaggcggcagatgaccagacatacggagaagcttatccatatacaccattcccggcagaaaatgataatgataaagcaaaagaatatctggatgcagcaatgaaagaaatgggcgtttctaatccggcagatatcaagattactcttcttacaactgatacagatggtgctaagaagcaggctgaagttcttcaggaacagtatcagaagaaccttggtattacagtagaaattaaccaggtaacttacaaacagagacttcagatggaaactgaaaaagattacgatatggtagtaacaggatgggttccggactactctgacgcatactcttatctggaactgtggatcagcgatggtcagtataaccactctggatatgcgaacgctgaatacgacaagcttcttaaagattctcagacagagacagatgctaagacaagacaggatatgctgttccaggcagaaaagatcttccttgaagaagattccgctcttgtaccgcttcagttacgtagagaccagtatctgatcaatccgaagatttctaacttcaatgtatactttgtcggatatgacttcgatctggtatatgcagacatcagcgaataatacagttggatggtaacataccttgcggtcggcgcggacttactggtccgcaccggctgcttatttgagggttttgattatttcgaggggtagatttggtatgtatcagccaataggaagtatgtgaaataatcaaagctatcaaataaagaaaaatgaagggagacaaaagaatggcaaaatatatagctaaacgagttgcattagccatcgtaacacttttggtacttacaagtgttgtattcgtcctggttcgtctgatgccgggagatccgttctcaagtgacaagatgacaccggagatcaaagcgaatctggaagcttactatggtttggataaaccgcttgcagagcagtatataacttatatgaagaatgtgcttcacggtgatctggggtattctatgaagtatgaaagtcagacagttaaccgtattattgctgactcattcccatactcagcagacctgggaatccgttcactgtgctttgcactgttcttcggactgatccttggaattgtagcagcactgaatcgaggaaagaaactggacttcgtctgtattttgattgcgatcattggtacatcgattcctgacttcatcatgggatctgtacttcagtatttcttcggaatcaaatggcagattcttccggttgcgcagtacacaagctttaagcacacaattttaccgtcaatcgcggttggattctatacactggcatccatttcccgtctgatgcgttccagtatgctggaagttgtatcttcagattatacaaagacagcacgtgcgaaaggtttatcggatttccgaattacatttaaacatcagatccgtaatgcgatcacaccgatcattaccattatgggaccgacagttgcatctgtattaacaggaacattcgtaatcgaagcccttttcgcaattcctggaatgggaaaacattatgtagacagtattaacatggcagattatacactggttcttggtatgacgatcttctacggagcattcctgattgtgtcaatcctgattgtagatatcttatacggtattgtagatccgagaatccgtctgagtggtaaaaaaaggtaggtgacgagaaatggcagaaattacaaaagaacagtttaaagttgtaggaaaaaatacaaagacaatggagtctatttcccgtccgaatattggttactggcaggatgcatggagacgaatccgcaagaataagattgcattcttctcattgtgcctgattggactttatgtacttatggcgatctttgttccaatgttcagcaaatatgacattgcaacacagagtgtggcagagatgaaccagagcttttcaaaagcacattggtttggaacagactctcttggacgtgatctctgggttcgtgcatggtctggtgcgagagtatctctgacaattggttttgcagccagcatcatcaatgcaatcgttggatctatcatgggtggtatctcaggattctacggtggcaagatcgatatggttatccagcgtgtcgttgacgtattatacggaatcccaagtctgatcgttaccattcttcttatggtagttgttggtaacggtgtacactgtttgattcttgctatgtgttgcgtcggatggatcggtggatgtcgtttcgttcgtggtgaagtattaaaactgagagaatctgatttcgtatctgcagccaagatccttggtgtgccggatatcgtaatcattgtaaaacatattttaccgaatatcatgggacttatcattacaaacctgacaatggctattccgggagctattttccaggaggcattcctgagctatatcggtctgggtattaaaccaccgaactgcagctggggtgtacttgcaaaagacggaatcgcacaactgagaattcatccgtaccaggtatttgtaccggcattcctgatttgtacaacaatgcttgcactgaaccttcttggtgatgggcttcgtgatgcatttgacccgaaacttagaggaaccgagtaggaaggagtatagaagatggaaaatttattggaagtaaaaaatctgcaattctctttccgtacatacggtggagttgtaaaagctgttcgtgatgtcagctttgaagtccgtccgggagaaattcttggtatagttggagaatctggatgtggaaagagtgttacctctcagtgcctgatgagactgaatccggaaccgcctggattctttgaaggcggagagattctttataaaggaaaagatgttctgaaaatgaacaaaaaagaacttcgtcagtttcgtggaaaagagatcagttatatttttcaggatcctatgacctcattgaacccgacaatgcgtatcggaaaacagattgaagaagtattcgtcggaagaaaaggtatgagtgcggctgagaaaaaagcaaaagcacttgaaatccttaaaatggtaggtatctctgatggagaacgccgttacaaacagtatccacatgaactttcaggtggtatgaaacagcgtgttatgatcgcgatcgctctggtaggaagcccgagcatcgttattgccgatgagccgactacttctttggatgttacaattgaagcacagattcttgatgtactgaaaaatcttcagaaaacacttgggacatctattatcctgatcacacatgaccttggtgttatcgcaaagctttgcgaccgtgtactggttatgtatggaggaaagatcgtagaacgtggatctgtagatgagattttctatgatacagcacatccttacacaaaaggacttatgcattcaattgccaaactggatacagcaaaaggccacaaattgcagccaatcgaaggaacacctccggatctgtttgcacctccgaaaggatgtccgttcgcagcaagatgtgaatactgcatggaaatctgtaaagatatgccgccacagacttatgagctttcaaaagaacatgaaacctgttgctggctgcagcatgaatatgcaccggatacagacatgagaagaaaagtaactgagaaaggagaggtgtaaaatgaaaaatacagaaaaaaaacagcctctcgtacaggtgaaaaacttatgtaaatattttgaaatcagccgtaaagaaaccttaaaagcggttgatgatcttacatttgatatttataaaggtgagacagtcagcctggtaggtgagtccggctgtggtaaatctacaacaggacgtaccatgatcaagttatacaatccgacttcgggaaatgtatattatgatggaaaagatattttcaaatacaatcatgcagagcagaaagaattctgtaagaaggtacagatgattttccagaacccgtattcatcactgaacccacgtatgactgttaaggatatcgttggagaaggtctgaaacaacatggaatgtcaacaaaggatgcagatgcaaaagtagagcagctgcttgctacagttggtcttaataaagatcatatgtcacgtttcccacacgaattctcaggtggacagagacagcgtatcggtatcgcacgtgctctttctgttgatccggaattcatcatctgtgatgagccgatttcagctcttgatgtgtctatccaggcacaggttatcaatatgctgaaagaactgcaggaagaaagaggactgacttacctgtttatcgcgcatgaccttagtgtcgtaaaatatatttctgaccgtgtagttgttatgtacctcggaacaatggtcgagactgctgagacagatgaactttatgctcatccgatgcatccatatacacaggcactgctttctgcaatcccggaagcagatccgaataaagcaaaagcgaaccagcgtattccgatcaagggtgagatcccaagcccgatcaatccgaagaactgctgtcgtttcgctgagagatgtcagcatgcgacagaacgctgctttaaggaaatgccgcagatgaaagagattgctcctggacataaggtggcatgccatcttgtagaagataaataaaaagtagtaatataataaagaaggcgaaggacttaagaagagttcttcgttttctttttgttttatgagaaattccgatggaactttctgtgaaaaaacactatatgccttggcagattaaaaaattttcagaagaattgtgcagaatcacaaaatacggattgacacgaaaatattgacaatataaggtaaaaacgatattatatagagatgtaattgtaattaaagtgtcatatcgtgtaatagttatgtaacaaatgaaagtgagtgtatatggaacagagaaaatcagcaaggagaagatcgtctgatggaacttctaatagaaatatgcgaagtatcaataacagcagagaagtaagcagacgggctaaggggaagaaccggtatgcttatgaagaagaccgaagatctgcccgatattatgatgatgaggaagattactaccgagaacgaccgaaaaagaaatcatctttgaatgataagaagaaaagaagaccggaagaagactatcagaatataagaaagatgtctgacccggagaataataagaatcgtaaaaataaacggcgtagaggaagaaagaaaaatcgggtaagcagaacgattggaattatacttgtaattatccagtttattctgtctgtagtacttgcagtgaatgtgatgctgttcaatgtacttacttctacttatttcctggtactgatcggagtgctgctgatcctgcttggaattaccttgctgacacagatagcggcaaaaggaaaaggaattggcggaaagatattctgtatactgatctgcatcattctgggagtgggttctttctatataggaaaagtaaataatgcattccagaagattaccggaagcaataagaaaacaagttccatggtagttgcggtaaaggcggatgataatgcagatactttatcagcagcagccgaatatacatttggtgttcagtatgcgactggtggagaccagacgaagtcggcagtcaaacagattgaaaaggaactgggacagaacattactcttcaggaatacagtaatctgggagaagaagcacaggcattatatgacggagaagtagatgcgattatctacaactcagcttacagtaatattatcaaggaacagtattcaacctttacaaaggatacaaaggttatttataagcacaatattgttgttgaaattgaaagcgatacatctgatgaaagcgttacaaagccatttgcggtttatttgagtggtattgatacaaatggtgatatcacagaacagggacgaagcgatgtcaatatcgtagcggttgtcaatccgacgagccatcaggtattactgattacgacccctagagattattatgtaccaatcccgggagtatccggaggacaggacgacaaactgacacatgcaggaatctatggtgtggatgtgtctatgcagacgctggaagaactttatgatacagatatcgaatttttcggaagagttaattttacatctatgaccagtgtggttgatgcacttggcggactggatgttgaatcagatctcgaatttgatacaggatgggagtcgggtgcagagattcatgtaaatgaaggaatgaatcattttgatggtattagtgcacttgctttttgccgtgaacgtcaggcactgccagacggggacaacggaagaggagtccatcagcaggcagttatcactgcaatcattaaaaagatgatgtcaccggcaatgctccgtggggcaagcgatattattgaaagcgtcagcgatggtgtggatacgaactttacttccagccagatccagtcgctgatcaagactcagctcagaaccaatgcaaaatggaatatttattccgtggcagcggatggaaccgggggaacagatatctgctattcttcaggagatgaagagctttatgtaacgtatccggatgaaaattcagtggctgagatcattggattgatcaaaaaagtaaaagacggagaaataatcgaaggatccgtaagtacagaataaaaatgaagaaaaagtcaaggtatgatttggaaaatatttttcagaataccttgactttttttttgcaatatactacaataaacaagcgtgcgaaaaacgatgcactgtttttctgcgcattttaaacagaacttgtttaaaatcgtaaccaattattacttcataggaggtgaaagagatgccaacatttaaccagttagtaagaaaaggtcgtcagacagctgtaaagaaatctactgcaccggctctccagaaaggatacaattctttgaagaaaagagctacagacacatctgcaccacagaagagaggtgtgtgtacagcagttaagacagctacaccgaagaaaccgaactcagctcttagaaagatcgccagagtacgtctttcaaacggaatcgaagtaacaagctacatcccaggagaaggtcacaaccttcaggaacatagcgttgttcttatccgtggaggaagagtaaaggaccttccgggtacaagataccatatcgttcgtggaacacttgatacagcaggtgttgcaaagagacgtcaggctcgttctaaatacggagcaaagagaccaaaagacgcaaagaaataagcacttgattttagtgtaaaacgaaactaaatcgtatcacaaacagaactatgagaatagttggttgcgggtttaattcagatatcgcctgccacgtggcaggcatcggagattgtcccgccaacgatacacatagaaagacacatgtgagtaccgatgaattattcacgcaaagcaaagctttgccaatatgtataaggagggaagaaccgtggcacgtaaaggacatactcagaaaagagacgtattagcggatccgttatacaacaacaaggtagttacaaagcttatcaacaacatcatgcttgacggtaagaaaggtgtagctcagaaaattgtatacggagcatttgacaaagtcgcagagaaagctgaaaaaccagctatcgaagtatttgaagaagcaatgaacaacatcatgcctgtacttgaagtaaaggcaagacgtatcggtggagctacttatcaggtaccgatcgaggtaagagcagacagaagacaggctcttgcacttcgctggcttacactgtactctcgtaacagaggcgagaagacaatggaagaaagacttgcaaatgaaattcttgatgcggctaacaacactggcgcatctgtaaagaagaaagaagacatgcacaagatggcagaagcaaacaaagcatttgctcactatcgtttctaattataggaggaaaaaatcttggctggaagagaatatccattagagagaaccagaaatatcggtattatggcgcatattgatgctggtaagaccactcttacagagcgtatcttatactataccggtgttaactataagattggtgatactcatgaaggaactgctaccatggactggatggaacaggagcaggaaagaggtatcacgatcacttcagcagctacaacatgtcattggacacttgaagatcatacaaaaccgaaaaaaggtgctcttgagcatcgtatcaatatcattgatactccgggacacgttgacttcactgtagaggttgaacgttcacttcgtgtactggatggtgctgtaggtgtattctgtgctaagggtggtgttgagcctcagtcagaaaacgtatggcgtcaggcagacacatacaacgtaccaagaatggccttcattaacaagatggacatcttaggtgcaaacttctacaacgctgtagaacagattaagacaagattggggaagaacgctatcgttcttcagttaccaatcggtaaagaagatgatttcaagggaatcatcgaccttatggaaatggaagcttacatctacaatgatgacaagggtgatgacatcacagtatgtgaaatcccggatgacatgaaagaagatgctgagctttaccatacagaactggttgaaaagatctgtgaattggatgacgaacttatgatgatgtatcttgaggacgaaatcccgacagtagatcagctcaaagcagttcttagaaaagctacttgtgaatgtacagcagtaccggtttgctgtggatctgcttacagaaacaagggtgttcagaagcttctggatgcaatcgttgaatatatgccggctccgacagacatcccgccaatccagggtgttgatgaagatggtaatgaagtagtaagacattcttcagatgaagaacctttctcagcacttgcattcaagatcatgacagacccgttcgtaggtaagcttgcatacttccgtgtatattcaggaactatgaattcaggttcttatgtattgaacgctacaaagaataaaaaagaacgtgttggacgtatccttcagatgcatgctaacaagagaatggaattggataaagtatattcaggagatatcgcagcagcgatcggattcaagttcacaactacaggtgatacaatctgtgatgaacagcatccggtaatccttgaatctatggaattcccagaaccagttatcgagctcgctatcgagcctaagacaaaagcttctcagggtaaacttggtgaatctcttgcaaaacttgcagaagaagacccgacattccgtgctcatactgatcaggaaacaggtcagacaatcatcgccggaatgggagaacttcatcttgaaatcatcgtagacagacttcttcgtgaattcaaggtagaagctaacgtaggtgctccgcaggttgcatacaaagagtccttcacaaaagcagttgatgttgacagcaagtatgctaaacagtcaggtggacgtggacagtacggacactgtaaagttaaatttgaaccaatggatgtcaatggtgaagaaacatacaaattcgattctactgttgtcggtggtgcaattccgaaggaatacattccggctgtaggcgaaggtattgaagaagccatgaaagctggtattcttggtggattccctgtagtaggtattcatgcaaccgtatatgatggttcttaccatgaagtcgattcttcagaaatggcattccacattgcaggttctcttgcattcaaagatgctatgaagaaatctgacccggtactccttgagcctatcatgaaagttgaagttactatgccggaagagtacatgggagatgttatcggtgatatcaactctcgtcgtggacgtatcgaaggtatggatgacctcggcggtggaaagatcgttagaggatatgttccgctttcagaaatgttcggatactctacagaccttcgttccagaactcagggacgtggaaactactcaatgttcttcgaaaaatatgagccagttccgaagtctgttcaggaaaagattttatctaacaaaaacgcataaaaaatacgaaaaaggcttgaaaaactgtactttatgaaatataatcagtattagccgagttaaaacatcgtaaactaaaatgccctattgggtggtatatttaaggaggatattcaaaatggctaaagctaaatttgaaagaacaaaaccgcattgtaatatcggtactatcggtcacgttgaccatggtaaaacaactcttacagctgctatcacaaagacacttgcagcaagagtaccaggaaacacagcagagaactttgaagatatcgataaagctccagaagagagagaacgtggtatcacaatttctacagctcacgttgagtaccagacagagaaacgtcactacgctcacgtagactgcccaggacatgctgactacgttaagaacatgatcacaggtgctgctcagatggatggtgctatccttgttgtagctgctactgatggtgttatggctcagacaagagagcatatcctgctttctcgtcaggtaggtgtaccgtacatcgttgtattcatgaacaaatgtgatatggtagacgacgacgaacttcttgaattagtagaaatggaaatccgtgaactccttgacgagtatgaattcccaggagatgatactccgatcatccagggatcagctcttaaagctcttgaagatccgaacggaccatggggagacaagatcatggaacttatggatgcagttgattcatacattccggatccagaacgtgatacagacaaaccattccttatgcctgtagaagacgtattctctatcacaggacgtggtacagttgctactggtagagtagaacgtggtgtacttcacgtatctgatgaagtagaaatcgttggtattaaagaagaaacacgtaaagtagttgtaacaggtgttgaaatgttccgtaaacttcttgatgaagctcaggctggtgacaacatcggtgctcttcttcgtggtgttcagagagacgaaatcgaaagaggacaggttctttgtaaaccaggttcagtaacttgccaccacaagtttactgcacaggtatacgttcttacaaaagatgaaggtggacgtcatactccattcttcaacaactacagaccacagttctacttccgtacaacagacgtaacaggtgtttgcgaacttccagaaggaacagaaatgtgcatgcctggtgataacgtagaaatgacaattgaactgatccatccagtagctatggaacagggacttcgtttcgctatccgtgaaggtggacgtactgtaggatcaggacgtgttgctacaatcatcgagtaatacaatctgaatatagatttgttatcgcaagataacgttgtgtccaaacgtaagatacccgtagaacttcggttctacgggtttttctgttgcctggaaatatataaaagagcggaaaagaataacgaacagtatagaaaaacggttgccgggagagtgtcttgacaaccgcttgtgataacagaatgataacaaaatatataattttcgcaaatatgataacagataaagtggatttatccacaaatcagagatgtgactgtggattaagtcagatcatacgtcttaatgtcattaccttcagtgcccttcttaacgatggtatgacaacctatcgtagttcccatggcacgtagtttccattcttcctgggtagcgttcagtttatccagttcttcctgtcttttatcttcattttcgatagctaatatttcagctttttccttttcatagatatttttaaattgacaccatttcctgaaaaagtcctgcattgtaggattatcgaatgtcagcgcaaccttctgatcaggtgtttcagcaagtgagaggttcactgaatcatcaatagaaaacaacagagagagtacatctccgactgtttcaatattaaaatccagaaaaacacttacatttaatcccagtgcagttgctatcttttctaactgatccggttttggattccggattccaagttcatattttctgatcgtacctacgttaatgccggacagctcggctaactgtatctgactgtatcctctgaattcccggtatgcccggatttttttacctaccattatggctgcctccttaattatatttgtgcttctattctagcacaaaagtgaatgatgtgaaagaggttgttttttcagagtggatcgtgaaacactttggaatataaaaataaaattcgcaaaaggttattgacaaagtcacaaaagtgaattatgatagaaaacatcaaaagagtcacaaaagtgactggaaaggaggacgatatgagaactaattatatgatgactgttgatgatgtcatgaaagaattaggcgtgaaacgcagtaaggcatattccattttaaaacagctcaataatgaactggcaaaggaaggatatgtagcagttcgtggaaagattccacgtccctattgggaaacaaaattttatggatgctctcagagagtaatgtgaaggaggttttaagatgtcagcttacaaagacaaagcacagggaacctggtatgtgagcttccgttatattgactggacaggaaagaaaacgcagaagctgaaaagagggttcaagacaaagaaagaagcattgaattatgaaaaggaattcataagaaagactgcagcggatatgaaaatggagatgggaagtttcatcgaagtttattttgaggacaagagaaaagagttgaaagaaaattcaatccgtaataagcagcacatgatgaataagcacattgttccgtattttggaacaagaaaaatgaatgagatcacaccggcagatgttatccagtggcagaataccattcaggaaaaaggttacagcaagacttatgaacgcatgattcagaaccagttgaatgcattgttcaatcatgcacagaaaatttacaatctgaaggaaaatccatgcaagaaagtgaagcgtatgggaaaatcagacgcagacaagctggaattctggacgaaagaagaatatgaccgttttattacggtgattgatccgggaagtgaggattatctgatatttgaaatcctgttctggaccggtataagggaaggggaacttctggcactgagcctttcggattttgatttgagtgggaacaggctgcgtatcaacaagacttataaccggattcagaagcgagatgtgatcgatactcccaaaacagaaaattcagtccgaaccattgatattcctaattttctgaaagaagaagttcaggaatatgtgaagaaacgttatggattttcggaaaaccagagattatttccaattgtggcaagaacactgcagaaacggctcaagagatatgaaaagcagagcggtgtgaagcagatcagagtgcatgatataaggcacagccatgttgcctatttgatttatcagggagtggagcctttgatcattaaagaaagacttggtcacaaagatattcagatgacactgaacacttatggtcacttgtatccgtcacagcagaaaaaagtagctgagatgttggacaacaaacgttaaatatggaggaaaagacacatgaaaacaaagaaagtagtcagaaaaatatttgatacgctcaattacagtaagaagctgaagataagttccattttaccggatcgagattcggattatgcgattcttcttgaattagaggatggaagcaaatttgaaattatcattatcccaacaaggagattcgtataaggagtggaaccatggctactgacagacaaaaagaaaaagcccagacaaaatatctgagcaagttctctgataatcagattcactgatatatcatcttggcagattcagtatatcacgaattgaacgatacaacaattcccgaatatctgttcatcagagacttgcccggaagggcaggaggtggatatgacaatatttgaacaggtaaaagagtgcgtaacagccaggcaggctgcagagcattacgggataaaagtaaaaggaaatggaatggcatgttgtccgtttcataaagaccgacacccaagtatgaaggcagataaaatctatcattgctttgcttgtggagtgggcggtgatgcgatagattttacagcaaggttatttagaatatcacagtatgaagctgcgaaaaagctgatagaaaattttggactggatataaaagttgaagacagaaacaaatacaaaaggacgcaccaaagcaggaatactttgatatcaaagaaacctaaagttgtgatgatcagagaaaaactggagcagtggttgaaacatgcaacagacgtgctgatcagatatctgaaatggattcagttttggaaggagttttacagaccagaaccagaagaagagtggcacgaattatttacggaggcattggcaaatgaaagaaagataaatgactatctggacgtgctgatgtttggaacaggagaagagattgtagagtttttcaagatgaagagaagggaggttgaaaaaattgaagaaagaattaatgaatatcagcgagaagtccttaatgggattagaagatattgtgaacgaggagatgcttacaacagaagatgtcaatgatatgttggagcatacggataaaggaagaacaaagcagacaatcagaaattgtgtaaccgtattacaaaaagatccagtgctgaaaaaagcgattaaacgaaatgaactttctggaagaatggatattgtaaaagaggtgccatgggaacggagaaataacagtcctacggttacagatactgatgaaaataatttgaagatgtatctggaagaaaattatgaactgacaagtgagcgtgtgatcaaagcaggagtagatattgtttccaatgaaaataaatatcacccaattagggattatctggagagtctggtctgggacggaattccaagaatagaaaatatgcttccacattttctgggagcagaaaagagcaaatatacaatcggagtaatgaaaatgcacatgctggcagcgatttcaagaatttatgaaccgggaataaaatatgatattatgttgtgtttggttgggagtcagggagccggaaagtccacatttttcaaatatctagcgataaaagaagaatggttcagcgacaatctggatcatttggatgatgaaaatatttacagaaaactgcaaaatcactggattatcgaaatgggggaaatgaaggcaactatcacagcaaagaatattgaacagataaaatcgtttctgagcagacagaaagaaacttataaagtaccttatgaagttcacccggaagacagaccgagacagtgtgtattttgcggtacttcaaatgatctgaatttccttccgctggacagaaccggaaacagaagatttgctccggtgatgacagatatgtcgaaagcagaagttcatattctggacaatgaggcagagagcaaagcctatatcgaacaggcctgggcagaggcaatggtactgtatcgacagggaaatgtgttcttaggatttacaaaggaaattgaagaagaggcaaagcgtctgcagaaagaatttatgccggaggataccaatgccggaatcatacaggcatttcttgatgactacgatgacgattatgtatgtacaagaattctgtttgatgatgcattgcaccgaactggagaaatgaaacagtgggaaggtaaagagattgcaaatattatgaacaatgcgattgaaggctggaaaccacatggtacacatcggttcggaaaggaatatggcatccagcggtcatggaaacgaatagaaggtactgagaaaaaagacaaagacggattcatggaagtatcggaacaattgaaaataccgtttgagtaaagattattgtaaacgatgtaaacggaacttaaaggaaaaacttaaaaagttaacttttaaaatcttttaagccctgtttacaaattccgtttacagacaggaatggagcagaaaataatgaaacagggaagattaggatataacagcagtaatggaagatatggattattatcatcagacttatggattgatacaggatttcactgcggagaaggactggaagtgctggtagatgatgaatgggtacagaccagagtggagatgaatttggcaagagaatggtatctggtagggacaccttattgtggagatctggaatatgtgcaggcgaggataccagaataaaacagatctacgatccacttcggctggtgtaaagcagacgtccactggacgttatgcccccggcagggcgcaaggggacttttgatggacggtacggctgtcgaaagtgcttttgcgttacttttgacaaaagtaacaaaaccgccgtatccggtgaaagtttcttaaatattgccatgtctggcgtaaataaaaattatgtgccatatctggcactcaaacagaaaagaggtgagaaaatttatgatgaaaagaacaatcagtggcatgatcggagccggatcactggctcataacagacgggattttatagcagaaaatgtaaatccagacagagtacaactgaacatttgttataagaatgagaatctgaaagaagtctataaagaactgtttgatgatgcggtggagagatacaatgtcgggaaaagaaaggatcggcaaattgcaaattattatgaaaaaatccgacagggtaaacaggagaagttgttccatgaagtaatatttcagattggtaatcgtgaggatatggcagttggcacgacagaaggagatttggccgtaagggtactggatgaatatatgaaagacttccagaaaaggaatccgtcacttcgggtatttaactgctatctgcatcaggacgaagctactccgcatctgcatattgactttgttccttatgtgaccaactggaagggaaaaggaatggataccagagtttcactgaagcaggcattgaaaagtcttggatttcaaggtggaaataagcatgatacagaactgaatcagtggataaatcatgaaaaagaagtgctggctgaaatcgcaaaacagcatggaattgaatgggaacagaaaggcacacatgaagaacatctggatgtttacaatttcaagaaaaaagaacgcaaaaaggaagtgcagaaattggaacaggaaaaagaaaatctgacagtggagaatgaaggattgacttctcagattgcagaagcaagggcagatattaagctactggaagaagaaaaaattcagttccagaaagataaagagatagcggaaaaacgtgcggagaaagcagaaacggaattgaaaaaactggaggacagaagagaattcctgcaaccagtgatggataatgtcagtaaggaaataaaagaatatggaatgattaaaacatttctgccggaagctacagcattggaacgtgcggtaacttaccgggataagaaaataaaaccattattcattgaaatgaaaaacaaaatcggtgcgatggctgcacaggtgaaagaactcacaagagaaagagatagttggaaaagtaagtttcagaagaaaaagcaagagcatgaaaaaacaaaaaaggaactggcagaagttcagaaagattatcagaaattgtctggtgagaaagaaatactacaggggcttgcggacagatataatcgacttttacgcatgctggggaaagatatggtagaaagactggtacaggacgatatccggatacaggaggaacttgaagcaaaaaagaggaaagagcaaatgccgaaaaaaataggtgaccgcatacaatgggcaagagaacgaagtgaagaacacaatgtacaaattaagaagaataaagcaaagtacagaggaatggagttgtaagaatatgaagaaacagatttatgatgaaaagaacggactgaactacacactgcatggagattattatctgccagacctggaaatcaatgaggaagaacctacatatgggaagtatggaataatgcgaaaacagtttttgaaggaacacaggagtgccaggtatcaatatctggtactgaccgggaaactgacggaacatctgaatcaggttgataaggaagcgagagaaaaagtcgagatactggtggagcagatggctgaacagtggggcgtgacggaagaattgaagatgcaggatcagatggaatgggtgaggaggaagaataatattcaagcaactgctgaagaaatagcatataaaaatataatctttatgtaggaaagaggctgtctgcaggagttgtggacagcctcatgtataggaggggttattcttcagatatatcatagtcagtggttgtatcagaaaattttgtatcccaaatggcttcttcaatggcttgtaaacattcatctgtatgtttggaaatatcttgcccccagaagtgaagaacagtatagcctaggaatagaagctttttatcattttcataatcacgattacgatttcgctcgatttttttgatccaaaaatctggattttttcctttttcaagccgaagtttgagaatctcccaatcctttccgtgaaaaaattcactatcgcaaaaaatagcaattttatatttggtaagaacaatatcaggagaaccagggagagctttataattttttcgatagcgataacctttgtgccatagagcttttcggagcaatagttctatggaagtatctttactgtggatcttacgcatattgtttgaaacagtagcggaatcacgtgacatataggtaccttctttctacctgaactgatgaaaatatattatcaaaaaacagaagaaatagcaaaggggataagaaacatacaagaggaaatctaacgatatagtgagaaaattgcttgttgctaattgtggtatatggtaaaatatgagttgtactatttttgattttggaggaattttaatggcgatttgttatgacaaattatggaaattactgatagataaaaaaatgaaccgtacagaattgaaggaagcgtcaggaataagttttaatgtattagctcgattaggaaagaatgagccagtttcatttgaatcaatagaaaaaatatgttttacattaaattgcaagatagaagatgttgtagagataaaaaaagaaaaatcaccacaaatcgatagcgatgcatttacaaccatagaactgtttgctggagctggcggtttggctttggggatagaaaaagctggatttgaaccattgggactaatagagtttgataaagatgcggcagaatctttgaaaaccaataggccgaactggagagttattcatgatgatatagctaatatatcttgtttggatttggaagattattttggtataaaaaaaggagaactggatttattatcgggaggagcaccgtgtcaggctttttcttatgctggaaaaagattaggacttgaagatgcaagaggaacacttttttatcactatgcaacttttttacaaaaactacagccaaagatgtttttatttgaaaatgttcgaggattgttgactcatgataagggaagaacatatgcaacaataacaaatatttttgaacaggcgggatataccattcagaaaaagattttaaatgcgtgggattttggtgtgccgcagaaaagagagagactaatcactgttggaattagaaatgatttagtgggaaaagtttcattctcatttccaaaagaacatgattataagcctgttttgcgagatgttttgttggattgtccagaaggaccaggggtaccatatggagaaaataaaagaaaaatatttgaattagttccacctggaggatattggagagatattgatccggagattgcaaaagcatatatgaaaagttgctgggatatggaaggtggaagaacaggaattcttaggagaatgagcctggatgaaccgtcattgacggtattgacttcaccgtctcagaagcaaacagaaagatgtcatccattggaagcaagaccgtttacggtacgtgagaatgcaagatgtcaaacatttccagatgaatggcaattttgtggaagtgttcaatctcagtataaacaggttggaaatgctgttcctgtcaatttagcatatgaaattgggttagagatacataaatcattagagggggtaaaataaatggcgtggaatttagattttatatcagaagaagattttaagaagcatgtgcgtgcaacgattatgaaatatggagaaaaactggaatcgtatgatttgaagcggttcaatagtaacctgattgatccgatcaagctgatttttgataaatcggtgtatcgtacaagctgggaagaaattgtaaataatgaaattttccggcagagagataagtctaataataatgatataggatattttcaccagaatattttttcctatttcaaaggctgcgaagtcccgcaggcaggctgggatgttatttacagaaaccccgatggaatacaaatgccagatggagatattgtacatacaatatatgtggaaatgaaaaacaaacacaatactatgaattctgcatcttccgcaaaaacatatataaaaatgcaaggacagattttggaagatgatgattgtgcgtgtctgttggttgaagcaattgcaaagaaatcacagaatataaaatggtcaacaaaagttgatgggaaaaatgtacagcataggttgattcgccgtgtgagcatggatcagttttatgcaattctcactggtgaagaagatgcattttataagatgtgtatggcattgccggaggtaatcaattctgttgtaaatgaagaaggcggtgttgaagtaccacacgatacggttattgatgaattgagaaaagtggcatcattatatggtgatgaaaacgatgaactgtctatggcaatggctgtatatatgcttggattcaatacgtatatgggatttggagataaaatccgtggagaattaggagaagataaagacggaatgctgaaacggatttatgaatatgtgagaaaaatgcagaaataaaagcatatcttggaggtgaaagatggagaaggtaatgaatgaaaaaattattatgaactatgaagtggtggaactattacacaaatcttcttcatggggaaatatcgtatttaaagtaaaaccgcaaaataaagaaaagttgtatgtgcttaagtgttttccgaagattgaaaatggtttgcaaaaactaatttttaaaagagagattgaagccttacgaacattgaatgtttgtgaaggaatagtaaagttaagagatagcagtacagagttatatccttttaaggagaatgaatgctatggtggcattcttatggattatgttccgggtgaaactttagaccatataaattggaataaatatacgcaactaaaaaagtatgaaatatgtcttcagattttaagagcagtaaataacgctcattcgaataatgtgattcatagagatttgaaaccttcaaatataatttatgataaatatgcagataaggttacgttaattgattttggaacaagtaaaataaaaacagttatggattccgaaactactatgccattatattcagaaggttattctgcaccagaacttatattgggtaaaaatatcacagaaaaatgtgattactattcaataggaataataatgagtgaaattttattatcacaaaaaaatggaagtgatattaatagtagaattgaggagtggactggaagaaaagagataaaagatattctattatcattagttcaagaaaaacctgaaaatagaccagagtcactggaaaatgtaattgtggttttggagcaattaataggaaatcttaatacatcaagttgtagctatagtattgcaattgattctagaaagctggttcaattaaaaaggaattctattgttgaagaaagtatgacaatggtacagtttactaattcatttctcaaaaatgaatttaaacaatcctatggttattatgatgtaaaagatcagcagtatgtaattactggtgaaagaatgattatgaagtgtggatatgatgaaaatgagcagaaaatgtatgtaacatatgttggaaaaattactgctgatagaagaaatataaatattaaaagaagctttagaattgttggacaaatgtcctttgtattaaatagcagagataatgggtatgatccacaagacaatcaccaactggttgttatgtttaaaaaccatcaagatgataataaacaatatcaattgcaagaagaaaagtttgaaaatttgtttggtggttgggaaattggtcttacagaggctgttgaaacagaaaaaggaaaatctgcgattataaaatatgataaatatgagattaatggtagtcaactgattttcaatctgattgattgcgagaaaaaatcaattgatgaattgatgccaccaactagatttgttgtagaaagccaaggatcaaaaggagttatttatacagaggtaggaaattttgaagaagttgtgtgtgatgatgattcggtaaaaattgtcttatcgttaacaaaagggagattgaaaccaacagtaagacaattattgaataaaaatacaccacttcttgaagattttcgtgcgaaaactatggcttataaacgacaatttagagcaatttttgatttgaacaaagatgaatattctgcgagaagtttaaaagacattatcttatgtttggatgaaccagaggaaataaagacaatctcacagcctagttttatttcaaaagtattaaatcaatcacagaaacaagctgtgatgaaggctctaaatacggaaaatatatgtttaatccaaggaccgcctgggacaggtaagacatctgttataaaggaaatagttgggcaaattataaaaagggatataaagatgacggacagtcctaaaatacttattgtttcgcagtcacatacggcagttgataatattttagaaggattggggaaagttattgataatccattggagataataagaattggtgcggaaaagaatatttctgaagaaattgcgacaaaatacacaattgctgcacatagagagcaattggtttccgaaataaaaaataatgttcagcaatatgtaaagcaaaaaaatgatttgatgaatactataaccgataaaaacgaggcgaaaaaatgggaagaagtaaagaaaatacaggaagattggataaatagattagtagatcagaacagtttagattatcaaatgatccgaagtgcagtggttattgcgggaacatgtgttggatttttgtctaatgaagtaataaaagatatgtcatttgattatgtaattattgatgaggctgctaaagcaacaacaccagaattactggtatcgattattaaagcaaaaaagattatattagtaggcgatcaaaatcagttgccggcatatgcagatgcagaggtatcaccaacattggctaaattgactaaaaatccagactataggttatttgatattttatacaattcgttgccagatacacataaacaaattttgaccactcagtatagaatgattgaaaatataggaaatctgataagtaaagtattttacagaggaattattgatacaggatgtaatgacgatgaaaaacgacatggattgagcaggtatgttggaaaatcaatagtgtggtttgatacttctgcaaataagaaaaaatcacagaaaagaacaaaaggtggttcatatataaatgaagaagaaaaaagaattatcttagaaatattagatgatttaaaaagtactggagaattgaaggggctagatatagggattattacagggtatagcggtcagaaagaattattgagaaaatctattaaagctacaggacttgacaaaatagcatcaaaaattgatattaatactttagatgcatttcagggaagagaaaatgatattataatttatagcactgtaagaacaagagattctattggatttcaaaaggagaaggaacgagttaatgtagctttttctagagcaaaaaaattattaattgtgtgtggagataaaaatttcttttacaattttgacgatcaggataataaatttgttgaaataatagattatatctctaaaggagaagaatgtgaaattatacaatgcgatggaggaaagttatttgaaagagaatctaattcataaatgggtaacaaacattgttaggcaaaatgatggatatgaatttttgtttgatgatgaagtatatttaccagtttataaatatgcactaaaaattacaaaaagaaaaactgtaaagctaaatttggtagaggaaaaagttttacagattgtttcaataggcgttcaccaagtggatgagattgcgaaaattttaggaattactaggccgttattggatgttactctcgcagatttgcacgtaaaagatttaatatctgtatcatctgatatttgctcgttattaaaaaaaggtgagcaagccctaagcaatttagaaagagttgagaaacagcaagatattatgaaagatatctatatggattcttttaaaggaaaaatattagatgatattactagatatcaagttgttgaaaaggggataattgatgataacaaactagaaccacttgttcaggcagaagatatgaaggttatagttagtagatttgaggatattcaagaaatttttcaagatgaatattctgcaatacgaattgccgatgggataagaacggaaacacaggaacttttgacaatagatggaattgaaagcgtatatgtagtatttataaagattccattgcaggtttttgtaagcacaaatggttgggatatagacattgtagcagcaaagaagaaatacaatgagttattgttagaatataaagatgaaattattaggcaaataaataacaagaaagtattacgggctcattggaaaaagaagacgatacaagagccatataatggagaatgtctaaaggaagttgaaggattagtagagacaataaggtctgctgattatagaggaaaaaagaaacaaaaagaaatagatgaacttcaaatgaaaatattttcatcaaggaaattgttaaatggagaggcgaagattttattggattatcttgctgagaatgcacaacaagttgagttaagtgtagataatgttgatgattgggcatatgataaaaattttgtggggaaattatcatattatattggtaaagcaactttgaaaatcaaatatcaaggtagtaataatattggaaaggctattgaaaggataaaaagagggcataatgttgccgaatataaaaaatgtaatcatgggtattttttttgcttgaaatatgatgataattatgaggtttatggagtacctaatgaacgaactgttataaatagtcatacaacctgtataaagatggattattatttgcgaaatttgagaattgaataatgtgtgataacatcatgataacaaaatccccaaaaaccacacggacacaatggaaaatccggatttttccacacgaatcacacgaaaaatcaccatttgtacaccgcaatacaccggtctgatatcgtgaaggtggacgtactgtaggatcaggacgtgttgctacaatcatcgagtaatacaatctgaatatagatttgttatcgcaagataacgttgtgtccaaacgtaagatacccgtagaacttcggttctacgggtttttctgttgcctggaaatatataaaagagtgggaaataataacgaacagcatagaaaaacggttgccgggagagtgtcctgacaaccgtttgtgataacaaaatatataattttcgctttttaataccaggcagacattccttcttttaaaatttccccggaattataactttctatgattttactgatagcatgatctgcaaaaaaagtttttgtaagcgcagttgttgctgaaggccattcttcttcggttaaaagtggaagtccttcttcttttctcgtttcattaatagaatttctgagttcattttgctcatctacagtaacaatatgggaaaaatcatcatgtgccattttttgaatttctacagtttcatttaatttgtcaattagtataattccatacatttcatcttcattaccatttggaaaataccaataagtaagatattgaccagtttcttcaattaatctaaaagtaaccatttcgtcacactttctatatatactaaaactaagttagatcataaactctgacagtattgccctcggtgccttttttgacgatagtatgacaacctatcgtagttcccatagcacgcagtttccattcgtcctgggtagcgttcagcttatctagttcttcctgtcttttatcttcattttcgatagctaatatttcagctttttccttttcatagacatttttaaattgacaccatttcctgaaaaagtcctgcattgtaggattatcgaacgtcagtgaaaccttctgatcaggtgtctcggcaagtgagagattcactgaatcatcaatagaaaacaacagggagagtacatctccgactgtttcaatattaaaatccagaaaaacacttacatttaatcccaatgcagttgctatcttttctaactgatccggttttggattccggattcccagttcatattttctgatcgttcctacgttaatgccggacagctcggctaactgtatctgactatatcctctaaattcccggaatgcccggatttttttaccaaccataatgctgcctccttaataatatttgtgactctattctagcacaaaagtgaatggtacgaaagaggttgattttcgcagagtatgaaaatatagaatggattataaaaataaaattcgcaaaaggttattgacaaagtcacaaaagtgaatcgtagtataaaacatcaaaagagtcataaaagtgactggaaaggagcagaaaatgacgaaacagggaagattaggatataacagcagcaatggaagatatggattattatcatcagacttatggattgatacaggatttcactgcggagaaggactggaagtgctggtagatgatgaatgggtacagaccagaatggagatgaatctggcaagagaatggtatctggtggggacgccttattgtggaaatctggaatatgtgcaggcaaggatacttggataaatagatctatgatctgcttcggtcggtgtaaagcagacgtacaccggacgttatgcccccggcagggcgcaaggagacttttgatggacggtacggctgtcgaaagagaacttaccgacaggaacaaaggcattagcaacgaagtacgagaaaagaggtatcaagagtatgtgcggggatgggtggaatacttcaggctcgcagatatgaaagagctcctccgaaaaacggatgaatgggcaaggcggagaatccgagcggtctattggaaacagtggaagaaaatcaaaacgaaataccgaatgctgaaagcactaggtttagaggattggaaagccaaggaactagccaatagtagaaaaggttattggaaaatggcgaaagtcttgaagcaaatcttttaaaaaaaataatagccaagctgggatatacatccatattcgactattatctaataatctgtgaaaactaaagaaccgccgtatacggaaccgtacgtacggtggtgtgggaggacggtaaataaaataattatttacctcctacccgattatgtttgtgtacaagaaaaaccgccagtagcagtttttttgtagtttatagtttttggaaaataataaaaaattagccatgctaaaaatgaccaaaattcattttttaattatgaaattattgtgactatttgatattgaccattagtcatttttttgtataatattctatagaataaaaatgtaaagacagggagatgattattgtggtcaaagcgggaaaatggatagcaaaacacagatttataattttgttactggggatactgcttttgattccgtcatttattggaatggcgaagacaagaattaactacgacttgctcagttaccttccggaatcactggaaacggtagaaggacaggatgttatggtggatgaatatggtatgggtgcattcgccatggttgttgtagaggatacggacatgaaagatatccagaagctggcagaccagtttaataaggttgatcatgtcgaaaaagtattatggtatggtgatgtggcagatctttcactgccggtagagatgataccatccgatttgagaaaagccttctacaacggagatgcaacactgatgctcgcattatttgacaatacgacttcatctgacgaagcaatgaatgcagtcggtgagatgcgtaagattgccagcaaacagtgttttattgcaggtatgacaggtgttgtagccgatatcaagaatgtagcaatgaaagaagtcccgatttatgttgtaattgcggcaattctttcttttctggtgctggaaattaccggagaatccttcctggtaccgatttttttcttgatcagtataggtgcagcaattgtatataatctgggaagtaacattttccttggcgagatctgttacgttacaaaagcgctgacggcggtattgcagctgggtgttacgatggattactccattttcctgctgaatagctacgaagagaacaagcgccgtttcccgggagataagaaccgtgcgatgggacatgcgatttctaatacattcaaatccattgtaggaagttctgtcaccacagtagcaggatttgtagctctttgtgttatgacatttgcacttggtcgtgatcttggtattgttatggcaaaaggtgttatcattggagtgctttgctgtgtaacaatccttccggcaatgattcttatctttgataaaccgattgaaaaaaccaagcataaaccgctgatcaagagcatggataaggtttcagcatttatcaccaaacattacaaagtatggatcgttgctttcctgatcttgcttattcctgctatttatggcaataatcatacaaaaatttattataatattgcacagtcacttccacagtcacttccatcaaatgtggcaaacagtgaactgaaagatgactttgatatgagtacaatgcatatagttatgttggataaagacatggatgccaaagagaaaaaggcaatgatgagtgaaattgatgatgtcaaaggtgtaaaatggacacttggacttaactccatcgttggatcttctattccggaatcgatgatcccggatgatgtaaagagtatgcttcagggtaaggataccgagttgatgtttgtatgtaccaagtatgagtctgcaactccgcaggtcaacaaacagatcaaacagattgataagattgtaaaatcctatgataagtctggaatggtaatcggtgaagcaccactgatgaaagacctgcaggatgtaacagatatcgatctgacaagggttaacgttatttcaatcgcagcaatctttattatcattttgcttatatttaaatccatctcgcttccgatcattctggtttcggttatcgagtttgcgattacgattaatatggcgattccgttctatcagggcaagagtcttccgttcgttgcaagtatcgttatcggagcaatccagctgggagcaaccgttgattatgcaatccttatgacgaccagatatcagaaagaacgtatgaaaggcaagagtaagaaagaatctgttgcgattgcacacagaatcagtatgccatcgatcattactagtggactgagcttttttgcggcaacatttggtgtgacttgttatacacaggttgatatgatcggttctatctgtgaacttctttcaaggggagcgatcatcagtgtgatcgtagtactgactgtccttccggcaatgttcctgatctttgatccggtcatctgcagaacaactgctggatacagagtgaaaaaagataaaagtaaaacagttgcagagccgacagcataggctctgctgaaaagggagcaggcttaactgattgaaatcagtaaaaagcctgttcctttttgctgtcatacacttagagaaaaatggcatctgaagaagctttttgtatgttgaaaatgggaagaaatggctgtgtacagacctttccggaaaatagaaggttgttcttttgattaaaatagtatatactatcttagtgttaccccaaaacattcaagaaaggattacatttatgaaaatgcagaaaaaacgaatcgtacagtgcggactttctctgatctgtgcattcggtatcgcgctgtcggggatgtcggtacatgcagaagaggtggacagcctcgaagataagaccagtaatctacagagtcagttggaagggatcaaccaggatctggttacgatcagcaatgaaatcgctgagacagaagtgaaaattgaagagtctaataatgaagtattccgtttggaagcatcgctccagatttcccgtaataacgaggaagtacagtatgcaaacatgaagactcgaattaagtacatgtatgaaaatggttcggacacactgctttctatggtatgtgaagcaaaaagtatgggagagttcctgaaccgtgtagactttatccagaatattacaaagtacgataaggatatgctggagaatatggtgaaagtacgtgaaggtattgaagagcaggaggctgaactgaaaagcaggcagcaggatctgcttgacctgcaaagccagctggacagtgaacaggcagcgttgcaggcaaaagcagaagagacttcgacagaccttgccacggtaaatgcacagcttgaggcggcacgtgcggcacagaaaaagcaggaggaggaagcccagaggaaagcggatgagcagctggcaaaaaaggcacaggaagagacaaagcaggcgtcagcttccgccggaagtaatacatctgcgggcaataattccgggaacagcagttcagcggggaataacagttcttctggcaataataatccttccaacaacaattcatcgaataatactagttccgattcttccaattccggaagcggtggctatgtgatcccatcaggcggtcttaccccgtcaaagggaaggatctggtataatggacataccgagacttactattctcagaaggtacttccgggaggagggcttgcgattccaggacgccatatagcaagtgatggaacaatcagggatgccgatggttacattgttttggcaagtgatgattacccgagaggaacagttgtagagacgtcacttggtgctggaaaagtatatgataccggaagtggatccggaaatatagatctgtatacagattggtaaaagaaaagcggggcagtaaaggacaaaccttttactgccccgcttttgaatttaatgggatatgtattttcagtgaatcgaaaaggcacattttgctttgtactggagaagtccggttactgtgcttcgtaggttgccttagcgtcacgtatcagcttgtcgaatttatctgcatcccatgcagcacgtcctgtaaagagtccatgcagaagaaacagaaaggtatttactcaccggaaggatgggctcactacaaagttacaggtgaagctgcaccggaagaataaaaatgttataatttgtttatggaatgaagtcctcttgtgtgttacaatacaagaggacttttgttttatagagaatagttgtcgaacgaaagggtgaaaactattaaagaaaggaaagtggaagagaaaattacagttcggatgacagatacatacctgtttgactttacgttatatcatacttattcgaaactggcaggttttctgacaaatattctggtagcagcgattgcttttatgggaatcatcatgctggttatgggaaagataaaacccgtgcagattattttttatctggcagcagcggttgtgtttattgtgtatacaccattgcttctgaaataccgttctaaaaagcaggtaaaaagaattgaacgttaccacgttccgaatgaaatgactttcaatgatgaaggtatccaggtagagtttgctgataaaaaagaaacttatgaatgggaacagatccagaaggtagttacaacaccaaagacaattggattttattatgagacagaaaaggaattgattgtaccaaaaccggattttggggacaagtttgtaccgattttgacattggcaacaaaaaaactcggaccggccagagtacatctgagatagcctgttatgtggaggggaaaatgttacaggaaagacggaatcatatattacagaaagtaacagaaaatggaaaagtaagagttgcggatttgagccgtgatctgtccggttaaggatgtatacaagatcattacggattcgcagatcagcaaagagtatatccgaaaagcggagcatgaacagattccacttgtgatagccggaaaccgggagcaataatatgatatatgagagaatacaaaaggggcgctttttaaagcgccctaatcgatttatagcaaaaatagaaataaatggaaaagaagaaacggtccatgtgaagaacacagggaggtgcgcggaacttctggttccgggagcagaagtgtttgtccggaagtctgaaagtgcagggcgtaagactggctgggatctgatcagtgtcaggaaggctgaccggctgatcaatatggattcccaggtgacaaacaaagtggtgcaggaatggattgaagccgggagatggttcaaggacgtgaagatcatcagaccggaagttacctataagaattccaggtttgacctgtatgtggaatatgaagagaaaaaagcgtttatagaagtgaaaggggttacgctggaagaagaaggcgtggtaaagtttccggatgcaccgagcgagcgggcagtgaagcatttaaaagagctggaagaagcggtgcgggatgggtacgaggcttatgtattctttgtggtccagatgaaaggagtacgttattttacaccaaacagacggactcacaaagaatttgcagatgttcttgcggaagcagcggaaaccggggttcaggtgatcgcaaaggactgttttgtaacggaggattccattgcaattgcggacgaagttccggtagtacttaccaatccacagctctatgaagcaccggagctgcttgtggaatggtacagagagcggaaacgggatctgccatggagacatcatgtaaatgcctatcgggtatgggtgtctgaaattatgctacagcagacgagagtggaagcagtaaagccattttttgagcgtttcatgacagagcttccaacggtaaaagatctagccgaggcaccggaggataagcttttaaagctctgggaagggcttggatattataaccgggtacgcaatatgcaaaaagcagcgcagaagatcgaggaagaatacgcaggaaaatttccggaaaattatgaggagatcaaggcgcttccaggaattggaaattatacggcaggggcaatttcttcttttgcctatggaattccaaagccggcagtggacggaaatgttctccgggtggtatcaagactgctggcgagcgatgaagatattatgaaagcgtccgtcaggacaaagatagaaaatgcgattgaaccggtgatcccggaagatgcagcatcggattttaaccaggggctgatcgaacttggtgcgattgtctgtgtgccgaatggggaggcaaagtgtgaaatctgtcctcttacgggaatctgtgaagcgaaaaggctgggaatccagaatgaactgccggtgaagaaaaaggcaaaagcgcgcaggattgaggagagaaccgttttgatttttaaggatggtgatcatgtggcaatccggaaacgaccggataggggactgcttgcaggtatgtatgagttcccgaatctggacggaaagcttacgatggacgaagtaaccgcttacagtaaatctatcgggcttgcaccgatccgtgtgaaaaagctgcggaatgcgaagcatattttcagccatattgaatggcatatgactgcgtatgaggtgatcgtggatgaactggagaagaactgcaaagaagagatgatctttgcacatccggaagaaatacaaaaggaatattccatgccatcggcgtttagcgcatggaaggtgaaataaaagaaggacattgcttttcgattttgcgaaatgcgatgtcctttctttggatcaaacaaaataattataagtgtttaaatcacctgacgtgcaagccgtggtgactttgcaccttcctgtgcataaattagtgagtacatgaaatatgccatcacacatgcagcaactacatccactacggaatgttgcttcaggaacatggttgacagaatgatcagaatgcttaaaacaagagatcctttctggatcagtctggagtgctgaagcttctcgcaatgggaaattgcgatgtaacaacaaatagagttgtatacatgaagacttggaagcacattcgtaggtgtatccgtctgatagatccgtttaaccagctcgatacagaagttatcatgcgtaaatacttccggtctcaggttcaatccgttcgggaataccgtgcagatgatcagaaaaatggtcataccgctgaacatgatcgcggaggctttgtaaaatccctgtttatcattaaagaacaaatatcccagtgtgactgcaatataagcaaaccacagcaggtacggaataatgaaatattcacaaaacgggatgtagtcatcgaatatcgaatggattacaaaataattgtcggtcacatggcgttccagataagtaaaccatggaaaataaataaaagcatatagtaatacccatgcatggctgtatgtatgcatcagtgtctttaattttttaaaaatatgactcatgataaaaatcagctccttcgggtgaagatgtttcttccttgttactagaggtagtataacattaaaaatttttctcgacaacagacttcataaaacattcatatttttttctattctctattttacggagaaaccttcaaagatatacatatcatatttattccgtgcagttttataagctttttgattgcggagtgtccagactgccattggaatacggtacagatagtggttcagccagacggaaggattgccggcatctgcaagtttataagaaataaagtccggacgacagatcaggttggtcagcaggaactgtacacaaaagcgcgccagaaaaggattttccggattcgtgcgagtcagggcagaagaaagctgtccacgaagaacctgaggcgcatgcttgtgaaaccatcggattccaagggagttgaaagactggaccatataaggccctttataatcctttaaaatatcccatgcggcaggacagagcttcatattgctgtccggaagcttcagttcaatcagaagaggaacccgcccattgacatagcgaaggacatctgaaaaaagtggcatatgctccgaagttccggaaagatgcaggtgctgtagcgcatcaaacgtggaatcctcaactgtcccttcggcattgcagatccgctttaaagactcgtcatggaatacgactacttttccatcacgggtgagatggatatcaagttcgatggcaagattttgttttactgcctcacgaaatgccggcatagaattctcgggaatcagccgggaagaatcatgtagtccgcgatgggcataatcccgcttgagataagggaggattttgcttcgacgggaagtattcggcatgatcatatataaatataagaaaaaacatacaacaacagttaaaagaatccaaaacaacagcatagaaaagtccccttcttttatgtaataattttcagtgtctcaggttcgagagagaacgaaacatccttctggagataaatcggttcgccgtcagaatgtaccggaagtgctatttttgagtgtacttctgcttttttacagcggaagatatgtacgcctggaagtcgggtatgctttccggaaaacacagtcggcagaattgcaagagcaataattttgggaacatttgcaatcacaataaagtccagcagatcatcatccggtttggcatccgggcagaatttgcatccaccaccttcataaggaagattaaatgcagaggcaaagaaaacccgtttaaaatgaagtcttttagtatcgtccagaagaatttccatctcatctggctgacagcggcgcagacggtagagtgagcaggctgcataggcaagtttgcccagaccaagccggttaaaaaagactttaaccctggaaatacaaagttgatggcagatagctgcatcgtatccgattccggaactgacggcaaaacggtgaaccttgtcatgatagtgcaatacaccaagattgatcttgcgcgtctgttcagaatgaagtaccagatccagagctttcatggtatcggatggaagggcaagtccccggccaaaatcattgccagagccgatcggaatgtaaccgagggtaacccggcttaaattctgcagaccacagattacttcatccacacttccatcaccaccaagtacaacgatcgtaacaggatccccggaggcggtaagctcggcggcaatttccgttgcgtgatgccggtgatgtgtaaaatggatctggtaatctatatgttctgctatcagctttaatttaatcttttcccatagtgcaagtccctgacccgagcgggcgttaggattggctataaaatgatacataaagtcatcccttcacttctgtaaatttagtttcattctagcatcggaatgagaggatattgtcaaaaaaacaataaaaatgcaaaaatttattgaggcagagtgttaaaagtgctattctggtacatgtgttaaaaaatgaacataaaataaatggaggtaatactgtgaaatttataagacaattcttgattatcatattgatttcttttgcaggagagcttttgcatgcaatccttccactaccggttcctgcaagtatttatggcttgctgatcttgctggcaggtttgcagacaaaagtaattcctttgaaagcagttgatgaggccggtggatttctgattgaaatcatgccgatgctttttatccctgcaggagtaggtctgatggtatcatggggagacttaaaaccggttcttgttccgatcatggttacaattgtagtgacaacagtgctggttatgggcgtgagtggaagaaccgctcagtttgtactgaagaaagaggagaagaaggatgagtaatatgctgcatggatcgacctttttttgtatggcgatcagtctttttggatatgaagcaggaatttttttgcgtaaaaagttaaaaattggtatcttcaatccacttcttgtttcgattgtttttgtaattatcgtgctaaaagtgactggaattgattatgatacttatgataagggagcgaatgtactgagttaccttctgacaccgtctacagtctgtcttgcaattccgctttatcagcagatgaatcttcttaagaagaatctgaaagcgatcattgcaggaattacaacaggtgtatttgtcagccttgccggtgtatgggtattttctatgttattccacctgaagaagcagttctatgtaacgcttcttccaaaatcaattaccacagcgatcggtatgggaatctcagaagagcttggtggaattgtgacgattacagttgctgcgatcgtaattaccgggattattggaaatatgtttgcagagggaatctgtaagctctgcaaaattgagcatccgattgcaaaaggactggcaatcggaacagcttcccatgctatgggaacggcaaaggcaatggaaatcggagagattgaaggagcaatgagcagtctttctattgcagtggccggattgatgacggttgtaggtgcatcgattttctatcacctgtattagagaggagtgtgcaaaatatggagaaaacaattatctgtatcggacgggaatatggaagcggcggacatgaaatcggtgaattgctggcaaagcgtaccggttatgcgttttacgataaagagaagctgtttgaaattgcaaagatgcgcggatacgagaaagaaatgcaggagtatctggatgaacagccggtggacagccttctttattcaatcgcaatgaattttgcagaaccgaagaagaagccatatccatttaagctgattgaagagcttgcggaagaaggaccatgtattattatgggaaggtgcgcaggttatctgatgagaaaccgagaagaagcttttagtgtatttgtccatgcagacatggaaacacgaattgaacgcgtgaaagagcgtgatcatattacaagcagaatgaaagcgaaacgtaagatccaggatgtggatgagaaaagaagcgcttttcgtaaggattataccggacaggaatggggaatgtcgaagaattatgatctttcggtcagcactacagagttgtcctatgaacaggcagcagatctgattctgtattataagaagatgacagaagaatctgacagagcttagaaggtataaaaagaatatactagtttgttgaatccagaaatgggaaatgacatggcaggtcatttcccatttctggattttagagatatagaagggctcaatttctatatcttagtttatagaatacgtggcttctataaattatttatatattcgttacaatcttttagagggcaaaatttgatttatctaggcatctcccatgcgttatgatccgtgtgaagcaacatatgtgacttgtgagaaagcggtttctcaaggaaatcacggtacagacggagtacatccgggttctcatgtgagaagcgaagtggcgcattcttatcaaggaaataaagattttcaccacgtgtccgtgcaagttcttctccgtcatggattggttgaccgccaccgccgacgcatccgccagggcaggccatgacttctacaaaatcataatgtacttcaccatgttcgattgcttcgatcagtttacgtgtgtttccgagtccgctgacaacagcagcacgaacagtagcatctccaagctggatctcagcttctacaacacctggctgtccaccaggattgcggacaatcttgaatgcatccggatcagggttacgtccggttacaaggtagtgagcagaacgaagtgctgcttccataacaccacctgttgttccgaagataacaccggcaccggtccattctttcatcagaggatcgcattcacgatcaaccaaagaagcaggatcaatatgtgcagaacggatcatgcgtgtcaattcacgagttgtaagtacaacgtctgtctcgtgtccggcatattcaccatagaacagttccatgttactttcgccttttttggcaacacatggcatgatagatacagtaaacatattttccggtttcacaccgatggattctgcaaaatagctcttcataacagaaccgaacatctgctgtggtgatttggctgttgaaagctgtggcaccagatgtgggtactgtgatttaaggaagcgtacccatccagggcagcaggaggtaaacatcggacgaagatttaattcgccttttgtaaatctctgcaggaattcatttccttcttccataatagtaaggtctgctgtgaaggaggtatcgaatacatagtcaatacccattttcttcagagcatccatgatcttgccgacagttgcttcttcacgggaaagaccaagagcttcaccccatgcagcacgtacagcaggagcaacctgtgcaacaacgactttcttgtcatcagcgattgcatcccatactttctctgtatcatcacgttcgcgcagagcgccgaccgggcagtgagtaatacactgaccgcacagagaacaggaaacctcggagatcttatggttgccggttacattaatggtagtacgggaaccagtacttgtcacatcccagatatgtaaatcctggatcttgtcacagacctggatacagcgcatacatttgatgcatttctgtgagtctctgatcagcggaaattctttatcccaagggaattcttccagacgctgcttaaatggtatttcgatgatgttcaggtcatttgcaagactctgcagagtacagttaccgcttctgacacaggtagcacatttgcagtcgtgctgggaaaggataagctgtacagtctgtcttctggctgtacgaacctttgggctgtttgtatggattaccataccttcttttactacgttgttgcaggaagttaccagccgttccattccctcgagttcaacaacacagacacgacaggctgcgatctcgttgatatctttcagatagcagagctttggaatcgggatatccgccattttggcagcatccatgatagtagtaccttccgggacagatacgtttatattatcaattgtaagatttaccataatgtttcacgacctcctttgaaaatgccgtagccgaagtggtcgcaacgcagacatctgctggcttcctgtttcgcttctgcctcggacatgcagttttctacaccgttaaagtcacagacacgttcgcaggcttcacgctcggtcatgtttactcttccgcacggcgggcggtcatcaagacgcgcttcaggaatctcaacgtcacagctgataatgtggtgatatcccaggtattcgtctatgttagcagctactacttttgcagcagcaatagctttgattacggatgcaggaccggaagcacagtctccaccggcaaatacacccggaatgttatcgaatccgccgtatttttcggttaagatcttacctctctgtacaggaacaccggcttcttcaaagtgctggtattcaatatcctgtccgatcgcaacgatcagtgtctggcatggaatgaatacgtcaggagcacctgtcggacgtacacttgcacgaccgtctttgatcttactgatcatctgtggtgtaacgtagattccttttacgtgaccgttttcatctgtttcgatgcgggaaggagccatcagagtctgtacttcgattccttctgcaacagcaccttcaatctctgccggaagggcagtcatatctgccacgcggcggcggtaaacgatgctgacttttttagcacccagacgttttgcggtacggacagcatccatagatacgttaccaccaccgataacggctacttcctgtccggtaagatccgggttctggttctttcctacatcacgaaggaactgaacagcagaaaggacaccttctgagtgttcgccttcgataccaagtttcttatcggtacttgcaccgattgtaataagaactgcgtcgtattcttcacgcagactctggattgtcatatcttttccaatccgtttgccaaattcaactttgacaccggtctcaaggatggcattgatatcatcgttcagacggtctttcggcagacggtagttcgggataccatagcggagcataccgccaagttccggcagcatctcaaatacggttgtctggtgtcccatcagctgcagatagtaagctgcacttaatccaccagggccaccaccaacaacggcaatgcgctttccggtagatggagcgcatggcggcggtggaacttttccggcataatcagcagccattctcttaagaccgcggatattgactgcatcgtctacgatgttacgacggcagcgtgcctcacaaggatgttcgcagataaaaccacaggtggtcgggaatggattgtccttacggatcaggcggatcgcatctgcgtaacgtccttctccaacaagagcgatatatcccggaatatctacatgtgccgggcacaaagatacacaaggaacaggctgtgtgtactggcaggtacatcttccctggcgcacatgttcttcatagtcttcccgacatcccatcagactcttgtaaaccatgtgagctgcttcatacccgatcgcacagtcagctccttccatgattgatacagagagttcttccatcaggtctaatgtttccatagttgcgtctccgttcataacgtcggtcagcaggtttttcagttgccacagaccaacacggcacggcacacattttccacaggtatgtgtatgacacatctccaggaaagcacgagtcatgtcaacaggacatagtcccggaggactggattcaattcttcgctccagatctttgtagagcccttcgataaccagctgggctttgtccggtgcagtgatttcaagtctactcatagcttttttctcctttaactttttttgctaatctacaggacagatgaagaaaatcatagggaaagcatctgaatactatagattaactctatggacacacttataatgatattgtatgcattttagtacaatcttgcaagcaaagttaataaatagacaaataagttaattttgtcacaaaatgataaaaaatatcagcaatatgtacaaaatggcagaacaacgataaagggtgcaaaaaataaaaaaattatgttacaataacacctgtaaaagagatgtctgttttacaggcacaattaacagaaagggcggaagaggaaaaatgaaagtaacagattttggtgcaacagttaaaggtgacgagacaaaattatatacgctcacaaataaaaacggaatggagattgcagtatccgattacggtgcaacgctggtacaggtgatcgtaccggacaaagaaggcaagccgtgtgatgttgtgcttggatatgatgaggcagcaggatatgaagaaggagatctgttcttcggtgcaattgtcgggagaagtgcaaaccgtatcggaggagcatcctttgaactgaacggagtgacctatcagcttgaaaagaatgataatggcaataatctccacagcggaatggatttttataaccagagaatgtggaaggtaaaagaaaccgcagatgatcatattacatttgaactggacagcccggatggtgatcagggatatccgggagctgtacatattgaggtaacatatactctgacagaagacaatacagtgaagatcgcttaccatgcagttccggatgcagatactctgatcaatatgacaaatcacagctattttaatatggatggacatgcatcaggagatgtactggatcaggaagtatggattgatgcagatgcatttaccagagccgatgccgagtctattccgacaggcgagatcacaccggtagaaggaacaccgatggatttccgcacaaagaaagcaattggcaaagaaatcgagacagattatgaagcactgaatttcgggaaaggatatgatcataactgggttctgaacaataaaggagaatttgcgaaagtggcagagatgtcctcggaagagagcggaatcactatggaagtttatacagaccttccgggaatgcagctttatacaggcaactttattgttgatgccaaaggaaaaggcggggcgcattaccacaaacgccaggcagcctgcttcgagacacagttcttcccggatgcaatccataaagagaattttgccgggccggtatgcaagaagggcgaaacttacgaaacaacaacgatgtacaagtttatataacaacagataagccgaaaaggtgccatggacataaaaatccatgacaccttttttgaaaatatgtgctgtaaaaaatcagcgaaggaatatgaaaaattcattttacgctgtggtatatctgtgaaatcagaaaatgccatccagataatgcccgatcgaacggcggatattaccttcaaaatcagtctctccgttatgcagacaccattcaaatacatttccgataaccagcatacggatatcagtgcagatttcatccagggaaatctttggcgcaatgatgccggcatcaatcgctttgcgaagataattctctacggtaaggatcgggtacggtcgctcggtacggatcgttgggttcagtgcctggttgcgcggtgtgtagtagttggacatgaattctactccgagttcccggcagtactgtgcgtaattcagataaacgtggatgataccgatctttgcctcatctgcatcttctggcgtatccagaagatccggattgatgcttggctgttcttcaatataataagataaaagatcatctttggttttaaaatgatgatagaagctgccgttggagacgcctgcttcatcacagatattttttatggaaagctgatcgtatccctgcttctgcagaattgtcttggctgcatgaaagatacgtgctttggtttcttttgattttttctgttgtctggacagtggctctttttcaatatcgcttgacatttggttaatcctttcttaaaatttttcagtcagattagctgtagtatagcatatttaatagaaaaagacaagaaaaccgagcgaactctgtaattttaacgggaattgaaaaataagagatgacatggtatcattaaatccatagcgaacaaaaagagaggattggatatcaatggatattaaccagaaaataacagaagaactgggcgtaaaaaagtggcaggtagatgcggctgtaaagctgatcgatgaaggaaataccattccgtttattgcgcgttacagaaaagaagcacacggtacactggatgatgaacagcttcgtaaattatatgaacgactgacctatctgcggaacctggaagagaaaaaagaacaggttcttgcaagtattgaagaacagggcaagttaacacctgagctgaaagcacagatcgtggcagcagagacgcaggttctggtggacgatctttatcgtccgtacagaccaaaacgccggacccgtgcgacaattgcaaaagaaaaaggtctggaatcactggcggttctgatctctcttcagaatagtaaggagcccctggaaaaagaggcagaaaaatatgtttctgaagaaaagggcgtgaaaaatgtgcaggaagcgattgacggtgcgaaagatattcttgcagaaaatatttcagatgaggcagattacagaaagaggatccgcgatctgacgttcaaaaagggtacgctggtttctgctgcaaaagatgaaaaagcagaatctgtatacgagatgtattatgattttacagaagcggtcagcaaagtagccggacaccgtgtgctggcactcaaccgtggagaaaaagaaaaatttctgagtgttaagattgaagcaccggaagaggaaattctccgttatctggaaaagaaagtgatccgcagggataatccgtacacaacaccggttttgaaagaggttgtggccgacagctatcagagactgatcgcaccggcgatcgagcgtgaactgagaaacgaactgacggaaaaagcagaagatggcgcaatccttgtgtttggaaagaatctggagcagcttctgatgcagccgccgatcgtcggacaggttgtgcttggatgggatcctgcattccgtaccggatgcaagcttgctgtggtagatccgaccggaaaagtaatcggcacgactgtaatttatccgacagcgcctacgactccgaagaagatccaggcagcaaaagatctgctgaaaaagattattccaaagtatcacatctctttgatttctctgggaaatggaacagcatccagagaatcagaacagtttattgtagaactgttaaaagagattccggaaaaagtgcagtatgtgatcgtaaatgaagcgggagcatctgtgtactcagcaagtaaacttgctacagaagaattcccaaaattcgatgtcgggcagagaagcgcgacatccatcgcaagacgtcttcaggatccgcttgccgaattggtaaagatcgatccgcagtcgatcggtgtcgggcagtatcagcatgatatgaaccagaaaaaattaggagaagcacttggcggtgtggtagaagactgtgtaaataaagtcggtgtggacctaaatactgcatcggctccgctgctttcttatatttccggtatttccggaacccttgcgaaaaatattgttgcctacagggaagaaaatggaaaatttgagaatagaaaagaacttctcaaagtaccaaaacttggaccaaaagcatttgagcagtgtgccgggtttatgaggatccagggcggaaccaatccacttgacggaaccagtgtacatccggagtcttacgaggcggcaggaaagcttcttgaaaagcagggcttcaagccggaagatattgcaggcggcaaacttgcaggtctgtctcttaccatcaaagattacaaaaagctcgctgaagaacttggaataggagagatcacccttcgggatattgtcaaagagctggaaaaaccggcgcgtgatccacgagatgagatgccgaaaccaattctcaggacggatgtccttgatatgaaggatctgaaggaaggaatgattctgaaaggaaccgtgcgaaatgtcattgactttggtgtatttgtcgatattggagtgcatcaggacggattggtgcacatttcccagatcacggatcgttttatcaagcatccactggaagcagtcagcgtaggagatgttgtagatgtaaaggtgatgagcgttgatttacagaagaagcggatccagcttacaatgagaggaattcagtaatacatgttcggatatgtgacggcgaatgagccggaattaaaagtaaaagattatcataaatataaagcgtattactgtggcctttgtcagtcactgaagagacagtatggcagcgcaggtcagcttacgcttgcctatgatatgacatttgtgatcattttacttacttctttatatgaaagtgaaacaaaggcagaaagccatcgctgtaagatgcatccgttaaagccacagccaatgctggaaaatgagatcacagagtatgcggccgatatgaatctgatcatggcgtattatcatctggaagatgattggaaggatgagaagaaagtagcagggcttctcgggagtatggccttgaagcgaaaagtagaaaaagcaatttggaaatatccaaggcagagtcgtgtgatcagagaagaaatggcaaagctttcggaatatgaaagtcagggtatacaggaagttgactatccggcaggctgttttggccggctgatggaagagatgatggtatataaagaagactgctgggaacagcagcttcgagggatcggtttctatctgggcaaatatatttacattatggatgcttacgaagatctggataaggacctggaaaaaggaacttataatccattaaaaaagatgcatgaagaagccggatatgaagaaagatgcagagacattctgtgcatgatgatcggcgaatgcgcaagaaattttgaaattctgccatgtgtactggacgtggatatcctgcggaatatcctgtatgatggcgtatggaaacattacagaaagatacaagaaaagaaaagcgaggaaaaggaagatgacaaagaatccttatgaggtgcttggcgtatcaccaaatgcgtcggaagaggagataaaaaaggcgtacagagaactgagccggaaatatcatccggatgccaatgtggataatccgcttcgggatcttgctgaagaaaagttcaaagaagtacaggaagcttatgatgaaattatgaaagagcgggcgaatggaggatataattacggatatggcgcgggttcagggaactattcttatggtaataattcctatgggaatcaatcttatggcaatggcagatatcagcagtacaataatatgaatccggagatgcaggcggcattcaattttatcaataaccgtagatatcaggacgcgatcaatgtgttgaaccgtatgaatgaccggactgcacaatggtattatgcaagttccatggccaacgccggcgtaggcaacaatgtgctggcaagggattatgctgcgcaggcagtgaatatggacccgaataacccgcagtacagagagctgatgaaccagctgaactggggagcacagagatataatagtaatccgtttggtcagggatatggcaatcgtaattcctctccgtgtggaactggaaatatgtgctgtgatctgtggatcgcagattcattatgtgaatgtatgggaggagatctgtgtccatgcatctaaatacaaaaaagattgcatttgcaggcgttatgcttgcactgacagaagtggggattgcgcttggcagtgtgatcgaaacgaatactctttttttactggcggcggcgtccttctttgtcgggattgtgattcaggaatttggattgaaaagcggggcaggctttttactggctggaattttgctggcaatccttctgtctccgaataaattatatgtggtttcctatgcatttatgggattttatattctaattatagaaacaatatggcatttttctggaagagcttccggatggatcagaagccgtaactttttctggctcatgaaatatctggtatttaatgtactttatattccgggtttaatatatttctggagtatgttatctgaaaaaaagaccgtaaaaggaataatgcttatgtctgttgtattcggacaatttatactttttgtctttgataagacatatgaatatgcaatggggaaaatctggaaagaaaatagacataaattcggattttaaagcatatataatacaataatgatgatgtgagtgtcgaaagtaaattttgctgctcactgatgtaaccggattgttctattgctacgcaattcccataatcctcgaacacatcataataattaaaatataaattttatgtattttttgcacaaaaaagtggaaaatttaacagaaaaattgtataatataagacaggacaaataggaaagagaggattcacttatgaagcagaataatatgcttgctatgatcttggcgggcggacgaggaagtcgtcttcacgagcttacaaataaagtagccaaacctgcggtttcatatggtgggaaatacagaatcattgattttccacttagcaactgtgccaacagcggaattgataatgtaggagtcctgacacagtatgagtctattttacttaacagttatgtagcggcaggccgcagatgggggttagatgcccagaacagcggagtctatgtacttccaccgcgtgaaaaagcggatgcggatctggatgtatacagaggaacagcagatgcaatttcacagaacattgattttgtggacatgtttgcaccagaatatgtactgattctttccggtgaccatatttataagatgaattatgataatatgcttgattatcataaagagactggagcagatgcaacaatcgcggtcattgaggttccgatgaaggaagcaagccgtttcggtattatgaatacggacgatgagggaagaattgtagagtttgaagagaaaccggagaatccaaagagcaatctggcatccatgggtatttacatattcaactggaagcttttaagaaagatgctccttgcagatatgaaaaatcaggattccaatcatgatttcggaaaagatatcattccgactatgctgaatgatggaagaaagctctacgcatacaagttcaaaggatattggaaagatgtcggaacaattgattccctgtgggaagcaaatatggatctgatcaatagtaaaaatgaacttgatctgaatgatgattcatggaagatttacacagaggatacaactgtgcttcctcagtatgttggcccgacagcagagattgaaagagcatttatcaaccagggatgtgtgatcaatggaaaagtcaaaaattctgtattgtttacaggtgcaagagtcggcgaaggtgcacagattattgacagtgtactgatgccgggcgttgaagtagaagaaggtgcagttgtaacaagagcgcttgtggctgatggcgtaaagattggcaaaaatgcagttgtcggatcagcagacagtgaacatattgaattagtatcaaaacgtgttaagggggatgagtaatatggcacaggcatttggaatcgtaagttttgccggcaacaatatccgggtaggagagatgcagaattaccgtccggttggtgctgtttcattccttggaagatacagagttatcgatttcccaatctctaatatgagcaacagtgaaatcgaacatattcaggtttatgtaagaagaaaaccgcgttctcttacagaacatcttggaacaggccgtcattacaatatcaactcaaagagtggccgtcttcatattctttattctgattttgcaaatgcagaatggagtgtatacaataatgacctggcggcatatgaagaaaatatggagtgtattgaagctgtaaaatatccatatgtagttattgcaccaagttatatgatttatacacagaattatgatgaattacttaagacacatattgaatccggtgcagatataaccctgttatatcacagtgtggataatgcaaaagaatactatctgaactgttcaacacttaatctgaacaagcagaagggtgtcctttcattggaaccgaaccatggtaacgcgaaaaaccgtaatattttcatggacacttatgtaatgcgcaaagatctgtttatggaactggttaaaaagggaagaaagatttcttccatgttcacacttaatgatattgtgaatatggcatgcagtgaactggatgtacgtggagtgtcacatcgaggattctttgcatctatcacagattttacgagctactataatgcaaacttatcactgatcgatatgaagaatgcagtgactttgtttgataagaactggccgatttacacaagaacaaatgattcatgcccaacaaagtattatgaaggagcaagtgtcaagaggtcagtaatttccaatggatgcttgatcgagggtactgttgagaattcggtaatcggacgtggatgcgtaattaagaaaggtgcagttgtcaaagacagtgttatccttccgggagttgtaattggagaggatgcacggattgaagcgcaggtagtggacaagagtgcaaggattgtccatgcaaaggaactgattgcagatccggaaaaaccaggatatgtaagaagaaacgatactttataatataatcaaaagaaattcaacagagagaagaatgccggcatgggcagacttctctctgttttttggtttcataaaaaaagaggctcataacgaaccccttttgctgctttgtaaaattataatctattcgcgtcccatttgtaaaatcgggctgatctttttgtagatcaggaatacgatcaatgataccaggaaacctttcagcagattgaaaggtgcaacagaaagtaaaacaaaagtcagaagactgttgatatgactgttgactgcggttcccatggcaatcagtgcgtcgatcggcatatggaatgcagcagcgtatgccggaagcagaaggtatgcattgataaaacatccgacaattgtcataaaaacagttcctgttaccataccgatgatcgcacccttgcgagaatgtaacttctgataaatcagggaagctggaatacacattgcacatccgatcaggaagtttccgaggtctccaacaccagctgttgatgtacctctgatcaggaggttcaacaggattttgaccagttcgatcaaagcgccggctacaggtcccatggtaaatgctccgataaggaccggaacttcactgaaatcaattttgtaaaaggttggtgcaaatggaagtggaatatcaaataacatcagaaccatagcgattgctccgagcacaccaatctgtgcaattacctttgtgctgatacgttttttttctttcgttgttgtttttgggtttgtcattacatctgtactcattttttctctccttttctcttgacataatcagatgaattgaggaggaaaatcttcgaaagcctatgcaaaaaaatccccgacgtaatggtatgctccccgtcaagaggacaataaaaaataataaatttttgtatcgtcagccatgctatggctggcgatattttatgctgcttttgtatattgctcatgatatttcattggtgtcattacatgcagtttcctttgaagtcgttggttgttgtagtaatctatgtaattagctatcgcagtaatcaaagagcttctgtcattaaaacgctgtttataatacatttctcgttttagaattccccaaaacccttccattggtccattgtcaatacagtgggcaactctagacatactctgcttcatatgatgtttttttaatctagtataaaactgtgcgcttgtatattgaaagcctcgatcagaatgaactaatgggtgtgcatctggctcctgacgaacagcctcatcaaacgtgtccataactaatggattatcattatgatcgctgattttaaaggaaacaatccttctatcatataaatctaaaatagcactcagataaactttatgaacttctattccgttgtagtatttaaattcagaaacatctgtaagccacttttcattcggtttttcggcgtgaaattcacggtgtaaatagttttttgctatgtgatcaggatttctgtctcctctggtacaactcttaggtttccatttaatatttgattttatatcgtatttcctacaaatacgaagtactcgtttatcattcacatgaattcctttatgtccatctaattcatcacgaatcctccggtatcccatatctggatgctggtgatgaatcctttggatttcagtggatagtctttcgtttcgaagttcattattacttttcggatattttccccagcggtaatacgcagaacgtgtaacattaagatatttacaaagtctatctatgggataatgcttagtagacgatagtttttggatggcttcatattcggctaaccgatggattaaagatagcgacccctcctttccagttctctgactttttttaacagatcattctccatttgtaggtctagatttcttctttccagttcagctatcttgtcacgtagctcttcttcaggtgttctgcttggaagagaagctatacgacgtccacgtctgtcttccagacccgcttgacccatcttttcgtatcgtattacccaattgcgaacttgttgataggaacaatcatatttgagtgccattgcaccataattcttatcatttgcaagacaatctgttactatttttaatctctcatcaagtgtagtgttctttgcctttttcatgtaagcacctccagtggatgtttttaatattccaccagaattatacaccttaatccaatcggaaagctgtctgtgtgaacgaattccgtattttgtgcaaatatcctgaagagatccttctccgttaagataatcatttatagcagatatttttaaatcttttgaataagatttgtttttcggttgattgagtaatccagttggtccatcatactgataaatagaaacccaatttcgaatactatgatgatcaactcccaattcttttcctgcttgctgtatgccaatttctcctgcaaggtagcgttcgactatttttactttttctactggttctatcttactctttctgaacatgaaaatacccccatataggacttttatatttcattgtcctatatgagggtagcatatcataatacgtcggggggattatttgcaaaatcactttttcttctctcatccagactttactgtcggttttggaattgcaccaaatcagctgtcagaaatctgacaggtcgcggactgtaaccgccggttgggaattctgcttatactatagcgataagaagtcaccctaccccgaagaatttccttgttcatttgaacacattatagcgcaggcgtatataaaatacaagtacaagttaagaaaagacaatgtttttctaaacccggagtgagcagtaacgacttgtttccaaagattcggtatgatataatcggtgtgacttaatctgatatggaggaaaatgaatgaatataaagtttgaagtaaaaatgacaaaaaaagccatgtttgattttatgctctatacttcctatacaagccttagcggaatcgttggtgtgattttcggtggtgtaacactggtgctgggaatcagacaatgtatgtttggaagctacagtacagctgcaacgttctttttgtttgccgcaatttttctgatcggaaacccacttcatttaaaagcacgtgcggcagaacaggtaatgcgctctccgatgtttcagaaaccgattagttatgaacttaacgaagaaggaatccgcatttcacaggatgaacaaagtgtgcttaatgaatggggagatttccgaaaggcagtttcaaccggtcagtctgtaattatatatgtaacaaaggtaagagcactgatttttccaagagaatccctgggagaacagtatgcggcagcagtgcagatgatttctacacatatgccagccaagaaagtcaatatcagacacgtcagtgcaaattaggaggcagaccagaagatgataattgaaacaaaaagtgccaaagaaacctatgatctcggtaagaagatcgggagtcatgcaaaagcaggagaagtctatacactggtaggagatctcggcgtcggaaagaccgtatttacccagggactggcaaaaggactggggattgaagaaccgatcagcagtccaacctttacaatagtccaggtatatgatgacggaagacttccgttctatcattttgatgtgtatcggattggtgacattgaagagatggacgagattggttttgaagactatgtatatggagacggtgtaagcctgatcgaatgggcgaacctgatcgatgagattcttccggcgaaccggacagagatcacgatagaaaaagatctggaacagggatttgatttccgccggattacggtagagaaaagaggagaataatatgcgcattttagcaatagacagttcgggacttgttgcaactgtcgcagtagttgaagaagaaaacgaaatttccaaaacgattgcagagtatacgatcaattataaaaagacacattcacagaccttattaccgatgttggatgaaatcgtgaagatgacggatatgaatctggatacgattgatgcgattgcggtagcaggaggaccgggatcatttaccggactcagaattggttcagcaactgcaaagggactggggctggcactgaagaagcctttgattcacattccgacagtagacggacttgcttataatctgtgttatacagacaggatcatttgtccgatcatggatgcaagaagaaatcaggtatatactggtatttatcagatggacggtgataaactgcaggttttggaagcacagatggcagtcgaaatcgatgaacttgccaaaaaactttgtacttatggaaaaccagtgatctttcttggagacggtgtaccggtgcataaagacaggctggagaaggaattgatgacgaattatgatattgcatttgcaccggcacatatgaaccagcagagagctgcagcagtcggtatgcttggaattcaatattataaagaaggaaaaacagaaactgcaatggaacacaaaccggattatctgcgtgtatcacaggcagaacgggaaagagaagaacgtctgaaagcagaaaaaacacatgagtaatagagataacatagaaattactttgataacagaaaatgacagagaacgaatggaacaggtggcgcagatggaaacagacgtatttccagatccgtggagttatcatgaagtgagatcaactgtcagacagaagcatactttttgtgcggcagcaatggaaggggataccctgctgggatattttctgtgttattatgttctggatgaatgcgagattgcaagaattgcagttgctgaatctgaaagacgcagaggaattggacagatgctgtttggatttatggaacagatctgccatgaaaagcaactgaaaagaatgcttcttgatgtccgtaagagtaatcagacagcgattgctttttatgaaaaaaacaaatttggaatcgatggagagcgaaagttctattacggagggaaaaatccggaagatgcaatcctgatgagccgtatggtttagaaaatggaagaaatcgcaagaatatacaagacttcccactggaaggcgtcagtctgtgacgttataatgtacctgaacatagaaagagctgaaaaatgaaatggcagtcttttttgcaaagatactcaggaggaagtaagatgcgtaattataaaaaaattcagacagaaaaaaatacagtcacaaagattgtgtgcaataaatgtaaaaaagaaatcacaataaaaaatggaataccggaggaagagatgcttacagttgaaaaaagatggggatatttttcgcacaaagacggagaactccatcgatttgatatctgtgaggaatgttatgatacctggatagcatctttccagattccggtatatggagaacaggagttagaatgttagatgtatgtttgcttggaagcggtggaatgatgccgcttccttatcgatggctgaccgcacttatgacaagatataacggcagccagctgctgattgactgtggtgaaggcacacagattgcgttaaaagagaagggatggagttttaaaccgatcgatgtaatttgtttcacacattaccatggagatcatatcagcggacttccgggacttcttcttacaatgggaaatgcggacagaaaggaaccgcttactctgattggaccgaaaggtctggagagagtggtgagttctctgcgagtgatcgcgccggaactgccatttgaaatccactatagagaaattacagagccagaacagatttttgagatggatggatatcgtctgaaagcatttcgtgtaaaacataatgtgatctgttacggttatacgattgagatcgaccgtgccggcaaatttgatgtgcagagggcaacagaacagaaaattccgaaggaatactggaaacatcttcaaaaaggtgagacagtagagcttgacggaagaatactgaagccggagatggttcttggaccacctcgaagaggaattaagcttacctattgtacagatacaagaccgacggattctatccggaagaatgcaaaagggtcagacctgtttatctgcgaaggaatgtacggagaaaaagaaaaagcggcaaaggcagtagaatataagcatatgaccttttatgaggcagcaaacctggcaaaagaggcggaggtgggagaaatgtggcttacgcattacagcccgtccctgcgccatccggaagaatatatggatgaagtgcgggcaatctttccacatgcgatcgcaggaaaagaccgtatgacaacagaactggatttcccggaataagcaaagcagtagagagaaggaaaaatatggatacagagaaaaaggatatattaatactggcaattgaaagttcctgtgatgaaacggcagcagccgttgtaaagaacggacgacaggtgttgtcaaatgtgatctcgtcacagatagatctacataaattatatggtggtgtggttccggaaatcgcatcgagaaagcatattgaaaagattaatcaggtaatagaagaggctctggaaaatgcagaggttacactggatgatattgatgcaatcggtgtaacttacggtccggggcttgttggtgcgcttcttgtcggtgtggcagaagcaaaagcaatcgcctatgcgaaaaagttaccacttgttggagttcatcatattgaagggcacatttctgcaaattatattgagaatctggaactggaaccaccgttcttgtgtcttgttgtgtctgggggacatacgcatctcgtatgcgtcaaggattatggaacttatgagattcttggaagaaccagagatgatgcggcaggagaggcttttgataaagtggctagagcaattggtctgggatatccgggaggaccgaagattgataagctttcaaaagagggggatccagatgcaatcccatttccacgcgcgcatatcgaagattccccatatgatttcagcttcagtggcgtgaagtcagcagttttaaactatattaacggctgcaagatgaaagggattgaatacaaccgtgctgatattgctgcatccttccagaaagcagttactgatgtgctggtagacaatgcaatgcatgcagtaaaagaatatggacttaataagtttgcaattgcaggaggcgtggcgtcaaacagtagtcttcgtgcagcaatgaaacaggcatgtgaaaagaatgaaatagaattttactatccgtcaccgattttctgtacagataatgcagcaatgatcggtgtggcggcttattatgaatacataaatggaaccagacatggatgggatctgaatgcagtcccgaatctgaaacttggcgaaagatagagtgggcgaaccacgaaatgcaggtaaaaaggagagaataatatgaacagggaaaaatgtacagcagtagtcctggcagcaggaaaaggaagccggatgggtacaaaaatacagaagcagtatctggaaatatgcggaaagcctgtactttactattctcttgctgcatttgcagcatctccgattattgatgaaattgttcttgtgacaggagaaggtaagactgattattgccggaaaaatattatagaagcttatggaatcacaaaagttaacaaaattgtggttggtggaaaagaacggtatgaatctgtatataaagcactaagagaaatagaaccggaaggttatgtctttattcatgatggagcacgtccgtttgttgatgaatcgatcatagaacgaacttaccaggcagtaaaagaataccgggcatgtgtggcaggaatgccatcgaaagatacggtaaagattgtagatgagaatgatttcgcagtaaatacaccggaacgaagatttgtgtggtgtattcagactccgcaggtatttgagactgcattgattcgtcatgcatattttaaattgatggaaaatgaagaaaatgaaacagggataacagacgatgcgatggttgtagagcgtatggaaaactgtgcagtaaagttggtagaaggttcgtatgagaatataaagattacaacgccagaagatctgatattagcagaaagtctgatcaaaaaaagaaattgaaaaaaattgaaaaaaagtgttgacaataatgtatcactatgatattatctatcttgtcgctgatacacagcaacaacttaataaatgcggagaggtatcgaagtggtcataacgaggcggtcttgaaaaccgtttgtccgaaagggcgcgtgggttcgaatcccaccctctccggttgaggcagaacaatatgttctgctttttttattgttctgcttggttttttgggggagtaaaaaggtgaaatgaaaaaaggtaagatttacctttgaaattacatcattttacaagattaaattccacatgagagtggaatttaatcttgtaagtgagtaatatataaaacttgaaaatagtactggacaaaaaagaaagaatcgtgtatattaaataacggacgttttggagaaatacccaagctggccgaaggggctcccctggaaagggagtaggtcgttaatagcggcgcgagggttcgaatccctctttctccgttttgttcaaagctaaaaagcagtaatcgataaaacataatattgaatgtaaaatacagatcaagaaaatgtgaaaaaagtcgaaaaaagtgcttgacattcaggaaaacggatgttattataaacaagctgatgcatgagaaatgaaagttttaaatgcagaacaaaaaataaaaaagttgttgacaaacatgaaacactttgatataatataaaagctgtcgcatgaaacggcaacaacaaaaaagaacattgataactgaacaatagacaacaaaccctgaaaattcttacaagagatttttcaagaacggacatcgaaagatgtcgaaccagaacagtaaacaggaacagaattgccaagcgattctgacccggatacaaacatttttaacgagagtttgatcctggctcaggatgaacgctggcggcgtgcttaacacatgcaagtcgaacgaagcacttatctttgattcttcggatgaagaggtttgtgactgagtggcggacgggtgagtaacgcgtgggtaacctgcctcatacagggggataacagttagaaatgactgctaataccgcataagaccacagagccgcatggctcagtgggaaaaactccggtggtatgagatggacccgcgtctgattaggtagttggtggggtaacggcctaccaagccaacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggctgtgtaagtctgaagtgaaagcccggggctcaaccccgggactgctttggaaactatgcagctagagtgtcggagaggtaagtggaattcccagtgtagcggtgaaatgcgtagatattgggaggaacaccagtggcgaaggcggcttactggacgatgactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgaccggcatgtaatgatgccttttcttcggaacaccggtgacaggtggtgcatggttgtcgtcagctcgtgtcgtgagatgttgggttaagtcccgcaacgagcgcaacccttatcttcagtagccagcaattcggatgggcactctggagagactgccagggataacctggaggaaggtggggatgacgtcaaatcatcatgccccttatgagcagggctacacacgtgctacaatggcgtaaacaaagggaagcaaacctgcgagggtaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctcctttctaaggaagaagaagtaaggaaagttcgttgtctattgttgagttatcaaaactcagatacttctggtggcgatgcggtcaggggacacacccgttcccatcccgaacacgatggttaagacctgatcggccgatggtactgcactggagacggtgtgggagagcaggtggccgccagattataaaaggaagggcttatagctcagccggttagagcgcacgcctgataagcgtgaggtcggtggttcgagtccacttaagcccacttctttaaaagataattgaatatgggggattagctcagttgggagagcgcctgccttgcaagcaggaggtcacgagttcgaatctcgtattctccactaggttcgaaagaaccgcatgtacattgaaaactgcatacaaaaataaatcaattctcaaatagagaaagacatccgaggtgatcatcaccgcaaggtaatgattaacttacatcttcgagaaaacgaagtaaaaaaacgacctgaaataccaacgcatgcaacgctatgcatgtgtaaccggatcccattcccgtgggagaagggagttggttatgctagaaagagcgcagggtggatgccttggcactaagagccgatgaaagacgtgataagctgcgaaaaacttcggggaggagcaaatatccaatgatccggagatatctgaatggggaaacccggctggacagactccagtcatccatacgccaatccataacgtatggaagggaacccggtgaactgaaacatctaagtagccggaggaagagaaaacaacaagtgattctgtgagtagcggcgagcgaaaacggaagagcccaaaccggaatgcgtgcattccggggttcggaccgcgtaattgatctgataagtttagcagaatggttttgggaaagccagccagagagggtgaaagccccgtaagcgaaagacgagtcagcaaggcgggatccagagtaccacgagacacgagaaaccttgtgggaatgagcggggaccaccccgtaaggctaaatactccttagtgaccgatagcgcatagtactgtgaaggaaaggtgaaaaggaccccgggaggggagtgaaagagaacctgaaaccctgtgtttacaagctgtggaacatctatatatgatgaaccgcgtactttttgtagaacggtccggcgagttacgccatctggcgaggttaagttcttaaggaatggagccgaagtgaaaacaagtcttaatagggcgttaagtcagatggagtagacccgaaaccgggtgatctatccatgtccaggatgaagttgccgtaaaaggcaatggaggtccgaacccacatccgttgaaaagggtggggatgaggtgtggataggggagaaattccaatcgaacccggagatagctggttctcctcgaaatagctttagggctagcctcatgagagtcttttggaggtagagcactgaattcccgcgggggcgtcaaagcttaccaaaggatatcaaactccgaatgccagtaagatgattcatgggagtcagactgcacgagataagttgggcagtcaaaagggaaagagcccagacctgcagctaaggtcccaaaatgtgtgttaagtggaaaaggatgtgggatttcaaagacaaccaggatgttggcttagaagcagccatacattaaaagagtgcgtaatagctcactggtcgagaggtcctgcgccgaaaatgtccggggctgaaacacactaccgaagctcaggaattaacgtagttaattggtagaggagcattcttaaagggaagaagcagtaccggaaggagctgtggacttttaagaagagagaatgccggaatgagtagcgagaggaaggtgagaatccttccggccgaatacccaaggtttccagagtaaagctgatctgctctgggtaagtcggggcctaaggtgaggtcgaaagacgtagccgatggacaacaggttgaaattcctgtactgcagtataacagaactgtggggacgcagagggagagcactagcgggaatggaatcccgcggcaagcgaggtaggagtcgcgctggcaaatccgcgtgacaatccgaagacgtgatgcataccgaactgaagtagggaaatgtgtgagccagctgccaagaaaagccgctattgtttgtactgtacccgtaccgtaaaccgacacaggtaggtgaggagagaatcctaaggccgacgggagaagcattgttaaggaactcggcaaaatgactccgtaacttcgggagaaggagtgccagtgagagctggccgcagagaattggcccaagcaactgtttagcaaaaacacaggtctatgcaaaaccgtaaggtgaagtatatgggctgacgcctgcccggtgctggaaggttaaggggagaggttagcgcaagcgaagctttgaacttaagccccagtaaacggcggccgtaactataacggtcctaaggtagcgaaattccttgtcgggtaagttccgacccgcacgaaaggcgtaatgatttgggcactgtctcaacaatgcacccggtgaaattgaaataccagtgaagatgctggttacctgcgccaggacggaaagaccccatggagctttactccagcttgatactgggattcgatattgtatgtacaggataggtgggaggcgaagaagcattgacgccagttgatgcggagccgctgttgggataccacccttgcagtattggatttctaaccagcagccgtgacccggctgggggacaatgtcaggtggggagtttgactggggcggtcgcctccgaaagggtatcggaggcgctcaaaggttccctcagaatggttggaaaccattcgaagagtgcaaaggcagaagggagcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgaagtaggtcccaagggttgggctgttcgcccattaaagcggtacgcgagctgggttcagaacgtcgtgagacagttcggtccctatccggcgtgggcgtaggatatttgagaggagctggccttagtacgagaggaccgggctggactgaccgctggtgtatctgttgttccgccaggagcatggcagagtagccaagtcaggaagggataaacgctgaaggcatctaagcgtgaagcccccctcaagatgagatatcccaacgtaagttgtaagaccccttgaagacgacaaggtagatagggcagaggtggaagtgcagtaatgcatggagctgactgttactaatcggtcgagggcataaccaagaaggtaggacagggtaagaaagaatggatggagtaaagatttaaatttgtatgtggttttgaaggtacatgaaagtatctttaatattcctcgatagctcagcggtagagcattcggctgttaaccgaagggtcgttggttcgaacccaactcggggagttgaaaactgtaagcaattgcttacagttttttcatttcataggaaattccgaaggaactgtatcgatgatatttatccggacaccatatgtggagtcggtcaaatttaaatataataaaagattcagtctgatttaggctggacagctctgcatatttgtattatagtaaaaacagtatttcaagggtgattgcgtaacaatgcttgttgcgttatcatcctttttggatataaggaggcaggataatgaaaaaacttgcatcaggaatggtaattctggcagggatactttggggaagcatgggaatttttgtccgcaagtttgaaatttgtttttttaagtacagtgcttgcattttgcctgtatacttccggtcttaaaaatttagataatggaaaagcttctattttggcatcagttgagccagttgcagctaccttgattggtgtaatactatataaagaaaccttatcagcaggagaaatattcgggattattcttgtgatggtagcaattgtaatgtgtaatcttacaaataaagacaaaaaataataaaataaagatgacgaatgccggagcattactccggtattcttatttggaattaggatgttaaacgaaacagctatttcataatcgggatgccttttgcaacccggcgataaatcttccatataatggtgaatggaagactgatacaaatataaagtgtagaaaaaagacctgtaaagcctccaattataaccaaaagtaacattccaatattcatgcctctctcactccagttctttgtatttcttttgataaagtcattttatgagaaaatatgtaatttgaaaagagattggagtcaaatgaacgatatttccactgatagtcagggtacgtttttcaaaatcgagtattagctcaccacatttgtaagggtggaagagttgatctgaagaggtattcatccgggtactgtgtctgagtgaggtgcggatacgtgcaaggagttcggcggaaccgaatggcttggtaatataatcatccgcgccaagatcgagagcttttaccttttcatgttcatttgtacgggcagagatgacgatgattggacagtcggaccattcacgaacctgccggatgattgtctgaccatccatatccgggagcccaagatcaaggagaatgagatctggacagatagaatttatcagctgaagaccttcagtaccggttatggcggttgttactttataattgtgcccatataacagctttgtaacaaaagtaaggatattttgttcgtcttctataaaaaggatatttacttttggctgcatggaatgttttcctcctcttcttttggtaatgtaaacagaaataaagcaccattggtgtggtttttggcttcgatataaccattgtgtgcgtcaatgatcgttttgcagattgataagccgattcccatacccttgtgggagtcaacggaaccagtattgtggcagatgccactgaaaatatccggaataacgtccgggttcagaccatgtccgaaatctttgacacagaaggttacgtggtctggatgatcagtgacggtaagctccggagaatggttgcttccagaatagatcaaagcgttttcaagaaggttgattagaacctgttcaatcagaattgcgtccattggaatcagtagataatcggttggaacatggacaataatactggctgaaggaaatctttttttcagacgttgtacagcttcagcaacaacttcttctacaatttcaggcgttttgttaacctgatgtgtaaccgtatcattgattcttgttacactgagaagattttcaaccatattgaggagccagctggagtcattttcaatattttcaagaagttctcttttttctgcatctgataagatggaaccatcagacagaagagaggaagtggttccaataatgctggtcagtggtgtacgcagatcatgggaaactgcacggagcaggttagcacgaagggattcctgacgtgcaatctgtacttgtttttcctgctttgcaagaatttctgtctgtttcttcagacgggaagtggttgctgtggtgagcaatgtaatgatcaacattccgataaatgtgaccggatagccgctcaatgtgaaattcagtcggaaaaacggataggtaaagaagaaattgatacagattacggagaaaacagaagaaaagagcccgtgcaggtatccgttcgtatatcgtgcaatcaagatttgggcaataatataaagtaatgcgatgtttgcagtattttcagaaacgaatgagaaaaaaagaaaggcaagtgcggtcgcgatgccaagtagtgtgagtgtaaaaagtgtattgttatgtaataatttattcatagcagataatcctcataaataaacaaaactatcatatttcctcgcaaatgtcaacagagataaaaaatcataacaaaatccagacaaagaggttgacatggcaaactgtatgtgatattgttacagtataaactgtaattaaaaaaaatacagttcaatatataagaaatgaggggagaagcgtgacaagtgaatttgcaatagcggttcatgcacttgtatttctggatcgcagcaatgctactatcgcaagtgaagaactcgcagataatgtatgtacaaatcctgtatgcatacgcagagtgatgggaaaactaaaaaaagccggtctgatcgagacaagagaaggcatgggaggcggttaccggatcgcaaaagcaaattcggatattacgctgaggcagatcagtgatgcgctggagaatacgcttgtaaaagcatcctggcgttcaggaaacccggataaaaagtgtttggttgcaagtgggatgtctgtagttatggacgaacttgtaacagggatgaacaggagctgtaatgattatctggaaagaatcacgatccagaaagtagaggaacggcttactgcccttaaagaagaaaaagataatgaaacaggaggatgtctatcatgtcagtaatcaatttaacaacagagaattttgaagaagaagtattaaatgcaaaaaaaccagtactggtagatttctgggcaacatggtgtggaccatgccagacaatgggaccggttgttgatgaactcgcacaggagcttacagatgtaaaggtaggtaaggtgaatgtggatgagcagatggcgcttgccagagaatataaggtaatgtcaattccgacatttctcgtattcaaagatggaaaggtcgcagagagaactttaggagttcaggaaaagagtgagctggaacagctgattcggtaagcagaatatagaataagttatctaaggatgtgccaaggcacatcctttttgtagtttgcgcgccatgggcgcgctctaacgggtgaaagtcccgaatacgcctaggtaacaaggaagtatatagctgaacagcaggggtgtccattgtgaggtggaatctgaaggaagctgtagtaaagaactagatgcaagaatttgttataggctgcatatgtgtatctggaagcaatggaaaaccccacagaattgtataaagaatttgatgaaactcggagttgataaggatacagcttggattacggcatacacaggtagtcgaatcgcttacatgtgtcaacgaagagttatgaattttgcaataaacaaagaaagattaacccgatttggactactgggacttatggcaattgattataagaagccggtaaaagttatttcagaagatgagaaatttatgaaacagattgagaaatgggctgttgaagaataagaatggatgaactgaaagatgggagagcatggggattttgcgctcccgttttgttgcgaaaaaaagagaaacgctgtaaattcaacgtttctcctactttttactaatgccgcagaccggagtcgaaccgttttaagtaatcaaaaatactgatagaaaggggctttggagacttcatcacggttgcggtgttcaaaaagtgttcaaacgtttgtcgcatacaaactaaaaagttgttactttctgcatagtgtatttcctaaaatgataattactacgacatcaaccaaaataatccccaatgcaatatatacaaaaaatgcaggcaaaatattttcaagcaagcccattgtcaatgcaagaattgctataatagacattccaattcccattgttctgcataacttcttttcatcatatttttccttttcttcttttgaagccgtattatatccggaaataaaccaactcccgtgtccagaaagtaaaataatagaaaatacagcaaatatcacaaagacaatccacactatccaatcagaacctgttgctaaatctactaatttcatttataagcacctccttaaattccgtttttcttaattcgataaactgaaatttatataattattcctctaactttccccattttataggctttcccgcctgtccattagtgaaatgatatgtagtttcccttatttttgcccttatgagataatcacaagggaaataagggaaattttttagtcattgcccaccactttatcaagaagccgaactgattttcgtttcgcatctcttgtggagtgagcatagacgttcattgtggtactgacatctgagtgtcccaacaattcctgcacatcttttggggcagctccatttgctaaaaggttgcttgtataggtgtgacgtaactggtggaaatgaaagccttcaaatccctctaatgtttttgccacctttctgcaaacagtccccaaagtagttggaagttccaaacaaccatccggtcttaaacagacgaaagaaatttctttataatctgtcgggacttcctctgttctgtctaaacaataatattcgtagtacactctgtttttctctttgacctctttgtagtagttcgtgtgataaagttctccgtactgcattcgattttttaactgctctttccgggcattacggaaaatctctaccagtgtatctccaaaatcaacaacccttacttttttccgcttggttggtccgatgatatatttgcgctttgagccatcatatcggatgctgcgtcttatggtaaggcattgttcttccagatttacgtcctgccatgccaaaccgcaggcttctccaatacgaagcccggcataataggctatctggattggaagtattgcggctgggttctttttttgcagataagcaagcaatctttcataatcttctcgtgaaattggttggacatttccgtccatatcctcatcggaaaacaaatccacttcatccgtctgataccgcagtttaatatactgcatgggattgaacgtaatatactgctttggaaatactgcaaaacggaaggactgctgcatgactgcggaaaaagaatggatataatctttgctgtaaccctttctctcttttccgtcgggatgaactcccccgaaggaaagcaaatcgaagaaggattgcaaatgttcagaggttacatttttcagtttccgttctgccaatgggtgtttcttgatatttcggattgttccgaggtaattctccaccgtaccattgctgagcgtacctgtttttaattcctcctctgcccacacatccaaaagctgtccgactgtgagattttccgctttggcaacaaatttctttttctcataatcatccattgcctgacggagcagcttttcagtttcacttttgctttctgttccaacgcattctttctgaacaagattgccgcttgcgtcctctacatagaagcggtagtaccatttctttcctttttttcttacagatccttttgccataatcgtatgtctcctttcgatattagacaatcggaactgatgaaatgcttcgtgcgtgtaagtatatcataactccggttgtcttactataccgattcggaatcttcgtataagacttctgataaaagatttgcaagcctttgttctgctgtttttggtttcttggaatagagccttacaacgtctgccatctcattaaaagcattgatggtgtgagtgatttcccttaagaacataatctcattatattcatcattcgattcaaaccctattgttttggcaatatccgtctgaccagcattccccttgaagtttttgcaggcgaactggaaggaatccaaaaacagaccatattgttttaacatcagcagtaataaatcttttgaaaaagcatcttcttctttggtaagggcaagcggtaactgttccagaatatctcccatcgcatcacgaatctgtaactctctcttatccgtaatgtcggtttcatattcatctgtttcccctttgagccattccacagatacatggagtgcttccgaaagaccttccagcaccatttttttcgtattgtcaatcgaaccattctcataacgcaggattgtagaagcggtaacacccatcttttctgcgacataaggctgtgtcagattcaattccagacggcgctgttttactctgctgcctatcagcttgcgtagttctttatctttcatgctgactgcctcctttttcggtatgtatgaattatagcattgtttttctgtaattgcaatatgcaacttaaaaattatttttaatatttcgtaacgcttgacaaaaagatatgaaaaggatatacttacatcacaagaattgcataatgcaatttataaggaggtgattatatgacgcaaagaaaaattgcattatccatcgaagaagctgctgactatacgggaatcggcagaaacaccttaagacagcttgtagaatggaagaaacttccagtattaaaggttggtcgcaaagtcctgattaaaaccgatattctggaaatgtttatggaagcgaatgaaggtcgtgatttgagggatagaggaaatgtaaaagccgtaacaagaactgcggcaaattaaaaaggcggcttccaaagaaaccgccaaaggttctatcagaccgaagccatgatatacctacacgcaagaagattataccatgtgcttcttctgatacgcaaccgagaacttatgtttgtaaaagaaaggggaatgtaatcatggcaaaatcaacaaaaagttatgaagaacgaatgcttgaaatggaaaagaaggaacaggaaagccttgaaaaagcaaaacgatatgcagcacagaagaaagaacttctgaaacgaaagaaagccgaagaaagtaaaaaacgaacccataggctctgtcaggttggcggtgcggtggaatccgttctcggtgcgcctatcgaggaagaggacatcccaaagctgattggttttctgaaaaagcaggaagccaatgggaaatttttttcaaaggcaatgcagaaagaaacacataccgatatggaggaagtgtaatggcgggggggatgagtttttcattcccttcattgctttttcatgaagggcgcacttatggacaaccagaggtcgtcccaataagtttgccacaagtggcaaccggtcttcgctcacgcttgccgggctcgttccgtcggcggggctttcagccagacctgctcatgccgcaggaggcactcttcgccagaggggcgcattccatgcaggctgctatgcgcagggcactcttacgcagagggcgttccggcaatactgctttttctaaaactgaaagcaatgttgccggaaatctatgccggatgtgcagaaagggggaatccagacatggcgatttttcattacacaatcaaaatagtcggacgaagtaaagggaaatctgttatctccgcttccgcatatctcaatggggatgtgatgaaaaacgaggaaaccgggcgaatcagttattacacttctaaaaaagaagtggtctacaccagtctgatgatgtgcgaaaacgcacctcctgaatggcagatagtaccagaagaaaatataaaacgctttcaaaaatctgtccgatacaaaaggtcagaagataaagaagctgctttagaaaaatttaaaatcacatttcagaaacaacggttatggaatgaggtattgaagattgaaaaaagtgcagatgcccaacttggcaggtcatttgaatttgccctccccaaagaatggagcagacaggaacagattcaatatacagccgactatatcaaaaaaacatttgtggataagggaatgtgtgctgattggagtatccacgacaaaggggatggcaatcctcatgtccatctgcttctgacaatgcgcccttttaacccggatcattcttgggggaagaaagaagtcaaagattgggattttgtcagagataaaagcggaaatatcgtgattgatgaatcccatccgaactggtggcaggataagaaaaaccctgaccgtcatggaatccgtatccctgtattagatgaaaacggaatccagaagattggtgcaagaaaccgcctgcaatggaaacgggtactgaccgatgctacgggatggaacaatccaaaaaactgtgaactgtggcggagcgagtgggcaaaggtgtgtaatgaacatctgcctttgcataatcaggtcgatcaccgttcttacgaaaagcagggaaaactccagattcctaccatccatgaaggtgctgacgcaagaaagattgaacaaaagtttcttgccgggcaggaaataaaaggttcgtggaaagtagcggaaaatcaaatcataaaacaacaaaacacgttattgcaaaagatactggacacctttgggaaagtatcaggtgcattatcattatggaaggagcgattaaatgacattagaagaaagccgggaaattatacccttaatggagtccatgattgggcaaatcgaagaacagcagaccttaatggcagaaatgcttctggaaatgcagaaccgggacacccaactctctcttatgcaggaacagaatcagaaattgcaaaaattaaacagcgagttatccgagctgctcaacattttgccaaataccgaggaactactttccaagatggaagaacagaaaacgaagatagaacttttggaaaacgaaaatcagcaatggcagatattggcacagaagctgaacagcgaaaacagtttattactgaaacagaacaccgaattgctgaactggaacagcaggtagagaaaggacgtgatatagatgaacgaatccagagaattaaagaacgccgaacagttggaagaacttctgctcttgaccgaggagatacaagaagagttggaacagaaagaccagcttatcgtggaactgaagacgcagctcaacgaatctctgaccttgaacgagaaattaaacaaagagaacagagccgggaatattcaagcattaaagaacgacttgaagctggcagacagagcattgcggagcgagaaagagaagctgcgaagcgcaaacgtcacgatagaggaatgtcaagataaaatacgatgcttaacacaacaacgggattatgcccggacacatcagaaaatcgtagagataccggtagaaaagccggtactctataaaaaatgcgaagcctgtgaccggacagcctatcagaatgcaaaagcaagatacgaaacacaaaaagagcaacttgcaggacaatataaagcaaaaacggtaatgttccaaacaaccttgttccttcttgcatggtattcgctgacaaccactctttttcaggcagtacagtcagatgtgttcctttccgattgcaaatcattcttccatgatgcagcatcattcatacaaacttttatcggttggacgattgatgccgggcaatctgtggcacaaatcagcacaaaaattccaaatgagattatagccggaatcatatattggttattgatgatattggttgttggaatatgtgtggcagggacagggatactggcaatactgatagaaataaaggttatagaattatataagaaaaactgttgggatgttattaccctactgatgatactgacaagtgcggctgtcatcatttattttggagaagtaattaaaaaagcattatcaataaatctgttgttcttttggttaattttacaaggaatatatcttacaattcgacgctatataagtcaagatactgattgactagatacaaaatatttgataaaatataaatagaaatacagcagatcaaaggaagtaaaacttatgagagcaaagaaagtgattgtaggggtagctattagtgcaatgttaatttcttcatcaattccagtaatggcattttctgttacaaacgggaataagacatttgataaaaagtgggaattgagcactacatctgatggcggaaaaggtgttttgacttatggttataatactcttgctattaatgaagattatgcacacgcatatcattcaactaaagatcattacgcatatgtcaagaatggaaatggttctttttcgggttcaaatgttggtaaaggtaattggtctaaaattgaggttgctcataaaggaaatagtattacctacggtaatagctactaaacaaaggttcgggataatggctgagtggttggaattccaaccactcttttttgtggagtgtatataaatgaagaaaaaaataaaatatataggaattgttttggttattttgttctgttgctataatttattttggtacttcgggagttataaaccatataacgaatttcagaaagacttccctgaaatagaagaatctggagtaaaaatttacacagataaagatggattccagtatagtgtgtctgtccctgattatttgctttggaatggaaatcttgcgatagctgagtcagatgttcgatatgcactaattatttggataaaaccatttcaccaaggaataagtcaaggcgtgctatttaatgactataaggatttgaatactcaaattatgttgtcaagtagcaaaaaagctgaagatcaagaagatcaatggattgttgatgaaaatagcacaatattgactacgatatttgaaaaagcaaataaagtatggaatctggggttgaaataaatgaaagcaattaaaaacttatgtttgttttgtttcctgatttttggaatacttatgcaatctgaaatatttcaagatcagctttggaacttttctacagcatattttacgtcatcacgctatgaagttgctagtgaagatatgtcgcagtttctgaaagatgtatcagaaactgcaacggagaatgatgtacatattttttctcagtacaatgaaatcaataataaatacctttcaacacttcatatttatggcgatgataaagtaatcagacaaacattaaaaaatactgcaaacatagaagaatcagaatataccgctttagtttccggaattacgaaagtaaaatttcataatctctcagaattgcaaagtacctctgtgggttatgaaaactttatctcatacataggaaatgaggacaatattatctctgcatatcagaaattatcagaaaaatatagcttaacttatccagaatattggaattctacggaaaaggacatgatttttattatatggggtatgattattgcattgatgattgttctaaatgtaattgaagtggttaggcgaaaaaaagaggttgttgtacgagtttccttaggagaaagtgctggtttcatagcatttaaggctgctttattcgatgtaacttttgacattgcattatttattgttgcaaaaatattgctgtcaaattatatatcgggagcatatgagaatagactcgtcacaattttatattccattggaattattctttccactattccatattgttctttttgcttttttgatattagaaaggcattcgcaaatgcaacacacaaaagaggagtggattttttaatttattcgttaaaatttatagcaggggtagccgctgtttttacaattaccactaatattagtagtattcataataacctatttacaaatgaacatttgttagaagaatattatgatgcaaattattttaccgtaaagactactgattttaatgctgaaaaagaagaagctttttggaataaactatacaagaatgaatataacacattaaagcctgtaatatgcttgaatattttaaatgataaaaatgatgtgatatatgtaaataatcatgcaaaagatatgttacaaggttttacgaagcagataaatgcagtagagaatgaatcttctgatttgattattttcattccaaagaatagatattttgctaaaaacaagcaattagcctatgactccttgagccatgttttaaatcatgataatttacaacaattaaatattcagtacatagagtatagcgaaacagaatacttttcctatttagatacaagtagaataaatggtatcgaaaaaagcaaaaatccgataattatttatcaggcaaacaaagatttagcagtcaatggtgggtatcttgaaagctataaagcaggagcagttttatttcaatgtgatgaaaaacagctaagaaatatcagcaaaaagtatgaagatatgcttggaaattatcagctagtaattacaaacgtacatgaacagtatttatataatcacacatttttaataaaactcgtgggatttttaagttctctttgtacgattgtattgcttttaaatattatgattattgttacagtaagtagactagagttccgagaaaatgcaatgaaaatttccttgatgaaaatctttggatatagtttatttgaacggcacaaaacacttcttaaaatgattgtagtggaaaattttgtgatattagtaggtatgcttatctattctttattatcggtacagactgaagtaggaattagcattcttgttagttcatttatggcactaatagaatttacaattattttctttaatatcacaattgttgaaaaaacaaacataccgaaatcattaaaaggaggttgcttatgataacaattgaaaatctatgcaaagcatataatgataaaattttgttcaaaaattttcatttggaaattccagatagccgttttttggtaattagtggcgaaagtggatgcggaaaaagtactttacttaatatgattggaggtattgaaactcctgacaaaggttctattattgtgaatggttttgatgtggcaaaaaaaggaaaaaagcagaaatatttcaaagaagttgttggatttttatttcaaaattttgcccttttggaaaacaaaacagtaaaagaaaatctagaaataataaaaaaatcaggtagaacggatatttcaataaatgaagctcttgaaaaagttggtttacagaaagtaattaacaaaaaagtctatcaattatctggtggcgaacagcagagagttgcgttagctcgtttaatgctaaagaaatgttcgattgtattagcagacgaaccaactggttccttagacaaaaaaaatagtgagattgttatgaatatattgcatgagttaagtgaacagggaaaaacagttattgttgtaactcatagtgaagaaattgtagcacaagaaaagcatgttctatatttataattacccataatagaagaatatgttctttcgggagacacctcctctaagaacatattcttttggttaaaattgattataaagatacttttatttcagtatattcgctatattgatgggatatatatttgcatattatttatatggataaggattataactctagtgagtcttctgcatctacccacatctgtaaattaccctcaagatataatcttgcatattccaaaggctcatccacagccaatgaagtaagcgcacattctgatccgtatgtggtttttagatttttttcagctttccagcaatcaatgcgaagcatatatccggcacttgtgtaaacatcaatactatcgtgatttatgttgtattctgcataaattgttctcatcgtatcttatctccattttcttttaataatcagttatagagttaaatatcgaaaacatttcaatcagttcaccatgtcgttattgttatactgtgttatgaaattttctttcccttattttttcccatattaaggttcatgaaaaccaatgtgagaatataacacaagggaaagagtaagggaaagctcacttgctacaaacttagtattttcaagggtttgcgaagaatttgataattaaatataacagttattaaatttcctaaaatatgtgaaatatcaactggaatttataacagtccttctgcttttacccgaattgcataaaactcttggaatgtatctggttcgtccattattgtttctttcataatttttaatctccgtttaccaattcgtctatccaatacagcaaatatttttacgattaaattttcacttttaaggcttgtttcaatatcttgattatcaaactctgcaaatgcattataaaaacagcgttggtcaaaaattcccaattttatagctacatcgtccatatacgcattttctacttttatgcgtttctcatatttttcgtcttggggaaacatgcctgctttcgaccaattgttccaatagcatcctttgatgatttcttttccatcatatcttattgccgcccgtccctcatggtcgggactcttactatatgatgttacataatactgaatatgaccttgcagactttgagccagatattccgtttccaacttttttcttataccactccatgttgccattcattattctccccaaataccgatttgtctgtttcatgttatacacagtataattccattttataaaatattcaattaaaaaggtatgcgaatattttttattttcgcatacccttttatcactttattcttttacatatcgaattaactcaccaatttcacattcaaaatagttgcatagtttacagattaaatttgcgtccagtctttgaaatggattccgtaaacagttccttacagacgaagcacttaaaattcttcacaaagcaaaggaattaaatccaaatggaatatatgtctttgaacccaacggcgagattatgacaacagacagctttaatcgccgtttgaagaaatattgcaaagaagccggtgttccttatcattccagtcataaaatccgcttttacaatgcttcaacagcttttgacggaaataatcttacaacccttagttatttaatgggacatagtgagacagctacaacattgcattacttgcggaatgtcaataagaggaagaatgacaggcttgcttttcagaatcttggtatttcatcataaagtgttcaaaggtgttcaaacattttaaaacaaaaaaataagagaaacgctgtaaattcaacgtttctcccatttttaactaatgccgcagaccggaatcgaaccggtacgggtatcactacccacgggattttaagtcccgggcgtctgccagttccgccactgcggcatatcattatgaaattataatgaaaatgggaccaatagggctcgaacctatgaccctctgcttgtaaggcagatgctctcccagctgagctatgatcccgaaaactgaataatcagttaagcgacccgaatgggactcgaacccacgacctccgccgtgacagggcggcgctctaaccaactgagccatcgggccatatgaaattgttaaaaaagtggaccttcagggactcgaacccgggaccgatcggttatgagccgattgctctaaccagctgagctaaaggtccaaattaaatacgtcccactaaggacaaaagccgatgatcggactcgaaccgataacctgctgattacaaatcagctgctctgccaattgagccacatcggcatattgctgtgtatatacaattggcttaaaccaagtgactccgacgggaatcgaacccgtgttaccgccgtgaaagggcgatgtcttaaccgcttgaccacggagccaaaactattttggtgaactgttttataacagtgaccgaaaattataatagcataactatatgattttgacaagtgtttttttgaaaaaaataaaatttttcggctaaatttttagcttaaggagaaaatgaggaatatctgtgtcggaaagctgaaaattcataagatgaaaaaaagagccgatacaaaactgtatcggcagagtagagagaagatatatataaaaggtataggtcaaagacatatgcctgattttttaggcggacatcctgataatcttacagagtttatatcatataggattaccggcgtcccttaactttatgcatttagtataacgggaaattatggaaagaatgtgacgggcagataaagaaatcctgaaatatcttaaaaacttctgaagaagagataaatttcagcaaaacagttgacgtatatagattatcgatataatatgaaggtacaaagtatatagataatcgatataaggagggagaaagaaatggcagttgataaaagtctgatatcagggagtacgactcttttgatcttaagccttctggaagagaaggatatgtatggatatgagatgatcgatacgttgaaaggaaagtcaaacaatgtatttgaactaaaagcgggaaccttatatccgctactgcattctatggaagaaaagggatggcttaccgtatatgagcaggagaccggcggaaagatgaggaagtattaccggattaccagagatgggaaaaagcagtatcaggcaaaaaagaaagagtggaaagagtattcggaggctattttacaggtgatcggaggtgtgtgttttggaacggcgtgattatctggaattgatgaccggtcagatccgctgcaagaaaatgtgtccggttattgtaagggaagtagaagatcatattgaagatcaaaagcaggcttttatggcagaagggatgaaggaagaagaagctgagaaggcagctgtggaggagatgggtgacccggtggaagtcggagtggagatggatcagatccacagaccgaagatgccatggaaagcaatttttgtaatcgctctgatgcagattttaagtggaatgtttgcagctttctttttgaaacagaatgaaagttatggatatatcgcaggaatccggcagatattccggcttgcgatggcattttcggttatgatcctggtgtgttatatggattacagctggatcgggaagcacgcaaggcttttggcaggcagttatctgttgtttatggttctgatgagacatttttttgcccttcagattaacggtgcagtaagatggattggagtcggcggcttcattgtaagtctttcgctgatgagctggctgtttcttccattgtatggtgcagtgttgtatcggtaccggggagaaggatatggtgctgttcttaaagccatagtctggatgctgcttatcgcagggatcctgatcacctgtccggatcttgtgatggcagggacggttggactttcctgtgtctttatgctgatgctggcactggaaaagggatggtatcaggttgcggttacaaaggtgatgaccggaataggtatcagtgttgttggagttccggttggcatactggcatattttttcttctttggtgcggaatatcagaaaagccgtatcctggcgatgtttgcagtgaataagtcacaaatgatggaaggaacaacgcttggggcagtacgggaactgctgtcgaaatgtatggcagttggacgcgccaccggagtagaggacttttggactggggaccgtatcagttccgcggattatatcatgcttggaattgcggggtattgtggaattcttgtgatggttctttgtattgcaataattgccggtttgctgtgctggtttttaagaagcgcgctgaagcagaagaaccagcttggtatgatgatgggatttggctgtgtgatggttctggcaattcagtttctgttatcactgctggcgaacattggggtatccgggttcggtcagggagcctggtgtctgttcttcggatatggacgaagtggccagatggtttcagcagtattgatgggaattttgctgagtatttaccggcatcagaatgtaactcctgagcttgtagttgaaaaaagagcggtggcgagctaagatagaagaaaaaagaggaggaacaagatgctggtttgtgattatattgtagagagaatcgatggagattatgcgatgctgaagcggaccaatctgccagaggaagaggcaaagatggtagcaagagcacttcttccggaagagatccgggaaggaagccgccttcattatgaattacttcagtatacaattgttgaataaaggtatggaaaatgtgtgtgccctgggactggaaagtgccggagcacacttttttcaaagtgtaattttctgtttagaaatttttcagaaaatattaagggaaatggatgtgcatatttaataaaaagagagtaaactctacttccgaggtgaagaatatggataagatttcggtagtagtaccatgttataacgaagaagaggcattgcctgtttattataaagaaatgtgccgtgtaatggacgagatgaaggatgttgtatttgaactgatttttgtagatgatggttcatcagatgcgacgcttggtatcatgaaagacctgaatgaaaaggatagcaggtgcagatatctttcattttccagaaactttggaaaggaagctgcgatttatgcaggattgaaagcatcggaaggcgattatgttgcacttatggatgtagatcttcaggatccaccgacgctattacctgagatgtatgagatcttgcaggaggatggatacgacaatgtagcgacaaaaagggtcacaagaaccggagagccacgtatccgttctttcctgtcagaaagcttttacaaatttgtcaatgctatttcaaagacagagattgtagatggagcgagagattaccggctgatgaagcggaagatggtgcaggcagttctggaaatgagcgagtataatcgtttttcaaagggaatcttcggctgggttggattccgtacaaaatggctgcagtacgataatattgagcgctctgccggaaaaaccaagtggtccatgtggaagctgtttaaatattcggtggagggaattaccggattttcagtggcaccgctctcactggcttcggtagtgggtgtactgttctgcgtgctttcctttattatgatcgcagtgatcgtagtaaggacgctggtctggggagatccggtatccggctggccgtcacttgcctgtattattttcctggtcagcggagtacagcttctctgtaccggaattgtaggggagtatctgtcaaagacttatcttgagacgaagaaacgtccgatttttattttaaaggattccagcgatgataaggagcagaagcatgaaagaacgtagaaaaggtctgctatgggaaatggcactgatcctgcttacggttgccgcctgtctgtactctacaggcgcaggaaatattttcggggcaaaggtggactggagcagtcagcacagtgtgttcccggaatatttccgacagcagttttatcgtacagggcagttttttcctgagtttgcattaaatattggcggtggtcagaatatttacaatttttcttattatggattgtttagtccggtcgttttgatcggttatcttctgccgaatgtgaagatgtcggattatatgatggtggcaagtattgtctgtctggcagcagcggttataattttgtaccggtggctgaaaagccgggaatttacagctgcggtaagcgggatgacagcgctgatgtttcttttcgcaggacctatgatctatcagtcgtcgcatcagattatgtttgtaaattatatgccatttctttgtctgacatttttgggaatcgaccgatattttgaacagaaaaaatccggtctgctgatcggcggaacctttctgatgatcatgacaagcttttatttcagcatcggtggaatactggcgcttggtctatatggaatttaccggtatgcaaggacaaaagagcgggcagaagagatgattacggtaaaaggatttctaggtgacggactgcggtttgcaagaaggatcctgacggcaatcatgcttgcaggagttcttcttgtgccgactgcgatggctcttctcgggagaagcggaagcaagggagaaaaaacagatatctggcagcttctgacaccgcagatcaatttggaaaaatttctgtatggggcatatggaccgggacttagctgtctgatgctgattattttgctgaccggacttttttataaaaaggcttatgagaaaatcctgtcgcttggttgtctggtggtgctgacagttccgtttttttcgtatctgctcaatggtgcactttatatcagaccgaagtcgctgatcccgtttttgccgcttctgtgctatcttacggcaaaatatctggagaagctgaaaaatcagaaaatagcgagaatctggatgcttcttccatgtctggcaattatcatatatatttatctgaagaaggatgatgtgaaaagcgaagtcctttggaaactacttttgctggatgcggtcataacactgttgatctgtgtggcacaagcgtatagtgcatggattcggaagtatttgacagtagccgttctgggaccggtgatcctgagccttattgttaccggaagctattcctgggaaaagagtggaaatctggagagcaggaaagcatatgaggaagataccagccggtccatcgggaaagctgtggacaaggcaattacatcagatagtggattctaccgggtcgagcaggttggaaatgaagaggaaaatgcggaaaatctgaatcgtgtgtggaacagtgaacaatatattacatccctgtattcgtcttcctataatgctgattaccagaatttccgtaaaaatgattttcaggtagagcagccgtaccgaaattttctgatgcagtcggtttcgcagaatccggtattcagacagctgatgggagtgaaatatctgatctccagtcagaatataccgggatatgagaaaaagtggatgaccgggggaggggatgtgtactgtaatgaaaatgcaacaccgattgcctatgagacggatcagacgatgtcggaagcggaatatgacagactggatttcccatataatcagctggtatttaccagatatgctgtgacaaaggacggaactgtatcggcaggacaggtgaaagaaaaactggcagaagacatagagaaatgtgattttcggattccggaaaagaataacgggatttcactggttgtcccgactgaaaatggatatcaggtgaaaatgaaaaaggaacaggaattcgaagtggctgtcccggaacaggaagagaaagatggagttctgtttgtacagtttcgaatcgaaaataaaaaaccgaaagaggatatcgaaatatccctggaaggagagcgcaataaactttcgtcaatccagcatgtgtattataacagaaataccgtatttacctatgcagtaggactggaaaaggggcagaaaacggtccgtttatctcttggaaaaggagagtatacgattaaagatatgagtgcatataacggcgtattaaatgaagataccggcctttatcagagtgtattcagggtggataaagagcagacgaaagggaatctgatccaggggagaatcaaaagtcagaaggatggaatgttcattacgtccattccgtttgataaagggtttgaaatgacgatagatggcgtaaaggtgaaatgtgaaaaagtgaataaagcgtttctgggatttcatctggaagcaggaaaacataaaatcagaattttgtatcatgcgcctggagtgacagcaggaaagatactgacaggtcttggcgttctgagtgtgatcgcaggggcagtaagaaagaaaaaatgcgcggagtgaatctttaagattctgaaataaaaaaggatacagtcttagagctgcatccttttttatttgacagagaattccgaagaagcttgtttttgccatccatgtatctgcaggtagtagtttactcctggcgcttgatctgaaaatgaacggcatcatcagaccagatcttatcggtatatcggatttcgatggtagaccagttcagtgggacttccagagaaagatatccttccagggtttcgccgggagcgatcgttccatcgagctttggctggtcgcttgtggttgcaagagcagtaaatgcagctgcactgtagtcaagtttggtatcgttacaataattttcaaagcttgccatactgctgatgaccagatcatcagatgtctgattgacaattgtcatatggacaaacataaattcattgccttctgtcgggacagaccagtcatctccttcggattctacgtagctgtccatcgtgatctcaatgccattgtatgcggcggtctcattttgcttatagatctctttggtggcatcagctgtcttcttcggtgttgaagtgccggaagaattgtcagaagaagtgtgcattttggaaaaaaggaatataaccgcaataatgatcaggatgagaatcaggatgataaacggcagactttttttgtgtttctttttggggtttgttagctggtctggtgaagttacatcatcagaagatgcatcggactttgtgcctgcagtatcgtttttggaaactggcgctggtttggcagcaggttcatctgtctgaccggagctgataactggttctggaactggagcatgctcctgtacggaggattcatttccggaaaaaggtttgtctgtagaaactttttcagtctcttttttttcagtggctttcttctgagcttctgtttcttctgcttccggaacatttttatgcatgctgcgcatggcagcagctgtgctgtggtagatctccggtccgttcaggggatcgtcgaaaaaagcctgctgtctggcagccgggcgcttttttccggaaacagatccatgcttatgagcagaagatctggcacttcgggtatctgtatcatccggaatcacagcggatgccggaaatcttttacggcaggtatcacagagatatttgccgggatattttttgctggggcggactttgtgaccgcatacagggcatttcattctaagttaagtctcctttatgattcaagtgttctgtttttattataggggaaaatcctgtcaaaaacaaggaggtattcttgtcgaacagacagaaaagtgatatcatactgactaagtaacgtggcagaaagtcgaagctgtcagatacaggaaaacaaaagaaagcagggaatgatatgacatatcaggaaatgatggaaaacgcaaaattatctatggggctttactgcaaagcctgtccggtttgtgatggaagagcatgtaaaaaccagataccgggaccgggcgcaaaaggtgttggtgatactgcgatcagaaattataaaaagtggcaggagatccgcgtgaacatggatacgatctgtgatggcggagaggcagacacttctgtgaatttatttggaaaggaatttaagatgccgttctttgcaggaccggttggatccgtgaatctgcactacagtgacaggtatgatgatgtttcttataacaatgtactggtatcagcctgtgcagatgccggaatcgccgcatttaccggagatggagtgaatgcaaaggtaatggaggctgcaacggaggcaatccgtgaaaatgatggatgcgggatacctacagtaaagccttggaatctggatactgtccgggagaagatggaactggtgaagaagtcaggagcatttgcggtagcgatggatattgatgcggcaggacttccgtttctgaaaaatatgaatccgctggcaggaagcaagaatgtacaggagctttccgagattgtgaagatggctggaagaccatttatcgtcaaaggcgtgatgacagcgaaaggcgcgagaaaagcaaaagaagcaggtgccgatgcgatcatcgtatctaatcacggaggaagagtgctggatcagtgtccggcaactgcagaagtgctggaagagattgtaaaagaagtgaacggttctatgaagattctggttgacggagggattcgctccggtatagacatttttaaggcacttgcacttggtgctgacggtgtactgatctgccggccgtttgttgtagcggtctatggcggtggagaagaaggtgtgaagctttacattgataagctgggagcagaactcaaagatgccatgcagatgtgcggtgcacattctgtttcagaaattacaagagatatggtaagatattatcaggactagaaaaatacatgcaggaggataatacaatgggaatgagagtgaacgcagagctgccattaccggcagacctgaaaaacgaatatccgttatcggataaattaaaagctatcaaggcgaagcgggatgaggagatccgtgatatttttacagggaaatcagacaaattcgtggtgatcatcggaccatgttcggcagacaatgaagattcggtatgtgagtacgtgaacaggcttgcaaagttaaatgacagagtatcggataagctgatgatcattccaagaatctacacgaacaagccacgtacaaccggagagggatacaagggaatgctgcatcagccggatccggagcaggcaccggatctgcttgccggaatcattgcaatccgtaaaatgcatatcagagccatgcaggagacttatctgacagcagcagatgagatgctttatccggagaacagaagttatctggatgatattctttcttatgaagcgattggtgcgcgttcggttgagaaccagcagcaccgtttgactgcgagcggaatggatatcccgattgggatgaagaatccgacaagtggagatttatcggtaatgctcaattctgttgttgcagcacagggaccgcaccgcttcatttatcgtgggcaagatgtgacgacaggtgggaatgatctggcacatgtgatcctgcggggcggcgtggataaatatggcacaacgattccaaactaccattatgaggattgcaagagacttctggatatgtatgagcagaagaatttgaagaatcctgcagcgatcattgatgccaatcattccaattctaacaagcagtacaaagaacagctcagaatcgtaagcgaggtactgcatacaagaaattatgattcaaagctgaaaaaactgatcaaaggtgtaatggtagaaagctacttggtagaaggaagacaggatatcggcggaaatatggtatacggtaaatcgattacggatccgtgtattggatgggaagatacagtgagactgattgataagattgcggaagactgttaagtgtaaaaatacagtgtatcaaggttgaaaaactttgatacactttttttttggcagaaatgattacaaaattacagtaagatatatttccaaggcagatagaatgtatgttgtaaaaacataaattacgggttaatgagaaaacttctcaaaaattcctatagacaaaatcccactaatatagtagactataaatagttagaaaaagctaactagaataaatttaaacaaactcatacaagaggaaaacaacatgaactggatgcagaaagatgtacagacatctgctcagatggaaattgcatggcagtgtgctccggtattgaccggtgtaaagccatccaatattctgaccttgaaaaatgtaagtgaaaaggaagttgcggaaagtctgaaagagatgggaatttcatacagcatgctttgcgacagcggagtccgaaaagtatggctgatctacagagaagaagagattcttgaaatccttggaaaaaaagaatacagcgaatttcttgatacacttggttatcggggatttgagtttccacagatgcttcagatcatgaatctgagatttgaaggatatcagcatggaagtgcagaatttccacatgaacttggaattttcctcggatatccacttgcagatgtgaaagggtttattgagcacaacggaaaagatttcctttatcagggatactggaaagtgtatgagaacgtagaagaacgcaagaaaatgttttctatctacaacgttgtaaaagaggaatttatcagggaaatgcaggcagggaaggatctgtggcatgcagcaagaagcgtgagacagccatttgacatacagcctgcataaaggaataaaacctggtagatgatagaaagaaaaaagaaaggaagaatttaaaaatgagtgatatttgtgtagcatactggagcggaacaggaaatacagaagcaatggcacaggcaattggagcaggaattacagcagcagggaaaagtgctgatgtagtaccgatggaaactatttcgcctgctgatttaaaagatcaggctgtctgggtacttggatgccctgcaatgggagctgaagaactggaagacggaacggtagaaccgtttgtatctgaactggaaggatttgcatcaggaaaaaaggttgccctgtttggatcctatgactggggagacggcgaatggatgcgtacatgggctgaaagaatggaacaggctggcgcacagatcgtcggcggagaaggacttatctgccacggaacaccgggagcagatgcaatagatgagtgtgagtcactcggcagggaggtggctggcttataagagatacgaataccttttaaataaaacagaaaaccgaaaaagctaaataatcaaataaaattataatcgaatcaaaaacaaataaaaatcaaaaattaaaagctaaataatcatcaaaaaagagccgctccgtttctgcggggcggcatacaaaaaaatcacaatcgttattagaatgaattaaggagatggataagaatgagcgttgtaattgtaggaggtcatgacagaatggtctgtcagtataaaaaaatatgcaaacagtttaaatgtaaagctaaagtatttacgcatatgtctgccgatctgaataagcagcttggacagcctgacctgtttgtactttttacaaatacagtatcgcacaagatggtaaaaaccgcgcttgatgaggcaaaaagaagcaatgcgaaggtggttcgcagccatacaagcagtggtgcggctctgacagaaattttaacacaggaagcaggagcagcagtttaaagcatgaatttatttaccgggatcatgatcccttttattggaacgacgttggatgtggcacttggatagaatgcagagtggaaaagcgaaaagaaatgaaatgaatgtgtcctggtatgaaaattatctgggcactttttatatgtgccaagctgggcaaatataaaaaagaggtctttctcacgaaagacctcttacagcgtgcgttagaggattcgaacccccgaccttttggtccgtagccaaacgctctatccagctgagctaaacgcacatttatatcgtgtgttgaactgtgttgctcaacaacaaaatcaagtatacatcagaaaaaataatatgtcaagtattaaaatgaaaaaagttcaaaaaatcttgacctcatttttgaacggggcgatgaaagccggtttgctggttcttattcgagataaggacagatctgattccatttggtaagcaggcgtttctttgaccaggctgcatttgccggacttgtggatggcagacagattgctttttgctgagtttgtggaaaacagtattttttatataagcggtatgcagtgccaccgttggtgaaaatctgccggatggatgccgtctgaagaatctctgaaaggtcattgggaacgacattgtggatactgctgtcactggagccttcgatatcacaagaggcgatcacatcccagacggcaatgtggtgtgcaaggagcagtgattttttctcttctatgccggcaggaagtggttcacctgtaagtgtggcaagaagatcccagaaacggtttcttggatgcccgtagaaaaactgactttcccgtgattttacagaagggaagctcccaaggatcagaatgcgggagtctgtgttaaatacaggatggatttcgtgaagtacatgtgaagattgagccataggtatgccttctttcataaatatattcaataaaaggataagcgatacgggagtgaaaagcaagtgggaatggaaaaagtacagtccgggttactgttcactcccgtgtcaatcactacgctgattggcacggaggatgcacgttttatcttgaatggcatctcgcccatcgccaaaggcgatttaaaatggcgagatgcgttgctggtcacaggtactgtgaacagtaaccaatctggcagaatgcacaagacagggaatccttgtgactgtcagaggattatagaaaataaaaagatcagtgactgattttagaacaaaaagtttgtgaattattgaaaaaagttctgcttgtaaagtggcagatgtcagtgtatagtgaagtcactctaattcgattctaattttattttataggaaattgcatccggtataatgaaatactctgaagatacgccgggtgacattctctgctttgaaacagatcacaagaaaagtatatgatatcagacacatgattcgatgtgacattttcaggacaagttaatatgaatgaacagacacagggaggaacaggatggaagaaagaagagactatgcggtactccgttttgtggatcagaatggctggagttatatggtaaatgactatgcaaaaggctgttctttgatggagtatatcaaacaggggatccgggtggaaaaagaaacagtatttgactggatcagacagctttcaaaacagctggaacagtattatcgttgtggaaatgaggatgcggcgtatggatatgtgaatccatatgcagtgatcataaccggagacggaatgctttgtcttctggatatcaatgaaccggaaaacgaggaacttttaaagcagatgaagaagaaaaagcttcgtatgctttttgtaaggaaagaaagggttctttcgcagaagacagaacggtcggatgatctgtatggtctggcaaagataatggaatttacagcagaaaaatgtctggatccaaaggcatttacacggaaagaagagcgagtctggaaaagaatgcttggaaagtgttatagcagtgggaaaaatgccataaaagtattgaaaaatatgcaaaaagaaattggttttctggaaagggaaatggaaagaccgagggataaggtttcggcaaaaaagattttgcttgcaattctggcggtttgtatcatgagtgcagcaatcatcggagggacagtgaaaaagccggaaacaaaagcgattgcagcggatcaggatcagccagaggcgggagttcaggaaggagtaaaggagaaaaaggagacaaaagaggttgtggaacaaaatggggacagtccttatctggaaatgggacttatttattatgtagcgtgggaagattatgtgaacagcctggatagtctcgataaggaaatgcaggagacagagttttccgatgcataccgggtagtcatagcgagtctggaagaagggagtatacagcaggaggatggattaagcgcagaagatgcagtaaaaaaaatattagatgaattggagaaacgtgcagaaaaaatacagatgaaagtgtatttgtaccaatacccgctattgaaggtaagtgttctggaagagagtgaaaaatggcacaggctgacaaagagaattggtgaggagatgattagaagacaggcgtggtaccggtgggatacaaatggagaaaaggagtgtgaggtcagaaaatatcttgcagaaagctattttaaacttggtgagaatttaaaagcagctgaacaatatgaacagatcagaaaattaaaatcgaatgaagaagaattagaagagatttatgaaaagctgcagttgatttatgaagaagcgcaggaatatgagaaagtgtgggagatcagcagagaggcggttgaagtattaccggattcagaaaggttgtggatgaactatctggagcgttattgtgagaatccggaaatggaaagagaattatgtgcagaagcagtaaaaaaggccatccaggcagttcctgagcttgcagaatcagaagcgtttaaacagcttcagggaaaatataaaattgtgatcgatggagaaaatatccgggttggagaataaaacgctgaaagaaatttttgaaaaagtcccataaaagggaggatgccgggtgacttaaaagcccccggcatgtattatgaaaaagttattctattattaacttctgcacgtcttattaaatgatttgtttgaaatcttttatcttttatgttcttcatttgatgattctagtatataaaacacttgtgaagaaagagtgtttaacaaatgaaggttttttgaaagataaatgaacaaattgtgaacaagactatttgcggaatgcgaagtatggaagcccatctttcataggtacttctacacttccctggatcagtgggcgggcataagcgatgaattcatctccgatgtcggaaccgtcttttgtgatccattcttcaggaacagctttttctttattacagatttcgttcacgtctgcagttccgaattcaaggatgtatgggtcatcactcttacggataaaattgatcatctttcctgtttcaccatctaaagcggcacttacagcaaaacggccggaagcagcggcttcgtccagatctgtggcagataaacaggaggaagagcatctctggcagacattgagttccacagagcgtactttgataccaagcttttcttttacgagattttcaagatactttccggagccagtcagcattttatgaccgaaagtatctgtgccgacatcacttgcaagctcgcagacaaaggttccgttaccatcgttgattccttcggaaatgcagacaacgagattagaagttttagtaagcttttcttttaccttttcgataaatgcatccggggagaaagcaacttccggaagataaataagaaccggattatcgcctttaaatttgcgggcaagaacgcttgcggcggtcagccatccggcatggcgtcccatgatctcgacgatggtgacagatggtttattatcatagacagaggcatcaattgcaatttcgcgtactgtagaagcaacatatttggcagcacttccgtagcccggggtatgatcggtcagaaccagatcgttgtcgatggttttcggaactccgatgatgcggatatcacttccgactgttgctgcgtagcgggataatttacttacggtatccatagaatcatttccgccaatatagaagaaatagctgatttctttttcggtaaatttctggaaaagttcaggataaaccggatcagaaagatcttccggtaatttataacggcaggaaccaagataagaacccggtgtggtgcggatacgttccagttcgccattttcttttaaaggtgccatgtccattgtgtgatcggcaagaaaaccttcgataccgttgatcataccgatgacattatcaatctctggatttgccagaccttctgagacaacaccataaagacttccgttgattacagcagtaggaccccctgattgtccgaccagtaaattgtgattcatagttgaaatcctcctctttattcatagtaatcatatagctttaactatagccgaaaaatgtgaaatttacaatatcagttggaaaacaaaaaaaattaggctatactaggaacgtgagctttaaattgagaaggagaatacacatgaaatatatatcgtttgcgattccgtgttataactcggcagcttatatggaccgggcagtggaatctattttaaaaggtggagaagatgtagagatcatcatagttaatgacggatcaaaggatgatacttcaaagattgcacatgagtatgaagaaaagtatccaacgatcgtccgtgcagttgataaggaaaatggtgggcacggagatgcggtcaatgcaggtcttgaccacgcagagggaaaatattttaaagttgtggacagtgatgactgggtagatgaagaagcactgtacaagattctggatgttctgaaaaagtttgaagaggaagaaaagcaggtggatatgctgcttgccaattatgtatacgaaaaagaaggaatggagcacaagaaagtgattgagtacaagaatgtgcttccacaggaagagatttttggctggaatgatgtgaaacatttccatctgggacagtatattctgatgcattctgttatttaccggacagatttcctgaaattatgtcagctcaggctgccgaagcatacgttctatgtggacaatatttatgtttactatccacttccgcatgtgcgtaagatgtattacatggatgtggatttttatcgttattacattggaagagaagatcagtctgtcaatgaaaaggtgatgatcagtcgtgtggatcagcagatctttgtcacaaagtgcatgattgatatgtatgatatgcgcaagatttctaataaaaaactgcggacctatatgactaattatcttgcaattatgatgacggtatcttcgattcttctgattcgttccaaaaatgcagagaatctggaaaagaaacgggagctgtggcagtatctgaagaagaatcactacagaacttattggaagatccgttacggaatccttggacagaccatgaatcttccaggcagatcaggaagaaagatttcgtctctggcgtacattgtggcgagaagaattgtcggatttaattaaaatttcttcttgacatttccgaagagaagactataataactgttaaagtaaatatggttcaccaaaattcgttgatgagaacaaagtcgtatccgtcattattttcagagagcctgtggatggtgtgaacaggtaataaccggataaggatatcctctctaagaagcgggtccaaagcagaaaaagtatctgcaagtagactttgccgggatccaccgttatatggatagcatatgttggtatgtgaagtgccgcagattattatctgtggaattagggtggtaacgcggattttattcgtcccttttcagattgattctggaaagggacttttttgttgctgtgtatacaaaaaaatcctgtgaattttgttatcggaagattagaagaacagttttgcgtggacgaaaagaaaaaggaggaaactgtaatgaaagcattacaaaaagcaagcaaatttttatcagactatacatcattggtggtaatcgctattgcagtagtcacattctttgtaccggcaatgatgggatgggtaaataacccattgtttgttgatccggtatccaacaagttcacctgtcagtcgatcatcatcggaatcatcatgttcagcatgggactgacactgacaaccgaagattttaagattctggcacagagaccttttgatatctgtatcggcgcaatcgcgcagtatctgatcatgccatttcttgcatttgcactgacgaaagtacttcagcttccggatggaattgcacttggtctgatccttgtaggctgttgtccgggtggtgtatcctccaatatcatgtcttatctgtgtggcggagatgtggcattttccgtaggaatgactacggtatccacaatcatttcaccggttatgacaccgcttatggtttcacttcttgcaagcggaacgcatattacgatcaaaggacttccgatgtttgtatctattgttgagaccgttattgttccggtagcttttggatttttactgaattatctgtttggaaagaaaaaaacatttacagagcttcagaaagtgatgcctggagttgcagtacttggacttgcatgtgtagttggcggagtggtttcttcgcagggagacaaattctttgaatcaggagttgtaatttttgtggcagtatttcttcataatggacttggatatctgctgggatacggcgcaggaagactgactggtatgaatactgcaaagaagagaacaatctccatcgaagttggaatgcagaacgccggacttgctaccaaccttgcaaccacaacggcacagtttgcggtggcaccggaatccgcaattatctgtgctgtatcctgtacatggcattctatttcaggaacacttctcgcaggattatttgcagcatatgataagagaaaagcaggaaagcctgcaaataaaaagcaggttgcagaaaatgtagcataaaatacagaaataatttcggaatggtcatcataaaatatcaggaataacttacagggcgtaagaagatatggaagatcagaaactggaaaatcttttaaatctggcacttggagcgacggaagaagaaagagaaaaatcattgaacctggatgtcgggtatcatccgattgacagggaatgggaattgattattaaatattcgggcaatctggatcaggtaagagccttggcaatccaggtggttgaacttcagaatgagtacgcgatcattcggatcagccagtccaggattgatttactttcagatattcctgaggtagaatatatagagaaaccgaaacgtttattttttcaaatagcaaatggaaagcgggtatcctgtatcaatgaggtgcaggatacccgctttcttgatctgcgtggacagggtgtccttgtggcgataattgattcggggattgattatgcgaatgaagattttcggaatgcagatggaacgacgagaatacgggtgatgtgggatcagtcattaagaccgaatgcggatgaagagaagaatccaccaaaagggtatcggatgggagtggaatttaccaaggagcagattaacagggcacttgaggctgactcgtcagaggaaaggagaagaatggtaccaagtcaggatatatccggtcatgggactgcagttgcagggattgctgccggaaatgggcgaggaagcggaaatctgtatgccggtgtggcaccggagagtgagctgattgtggtaaaaatggggtcgcctatgccagacggatttccacggacgacagaactgatgcaggcgatggattatgtggtgaggaaagcactggaatttcggatgccggtggcgatcaatctgagttttggaaatacatatggttctcatgacggcaggagtctggtagaacggtatattgatgatctgtcgaatttctggaagagtgtgatctgtgtggggaccggaaatgaagcagcaagtgccgggcatacttccggagtgctgcagaaaagaaaagaagaaagaatacagctcgcagtacaggcagatgaaccaacattgaatattcagatctggaaagcgtatacggacgaagtggaaatttcatttgtatctcctgcggggacgcggatcggtccaatacaatctgttctcggttcgcagagattccggatcggggaaacggagattttattatattatggaaaaccgagcccgtataatgtcgcgcaggagatttatattgatatgattccggtgacagattatattacgtcgggagtctggcagatcattttgaatccgacaagggttgtggaagggcagtatgatctgtggttgccaagtgagaatgtattgaaccgggggacaggatttttgtatccggatgaagaagtgaccttaacgattccttcgactgcagataaagtgatatcggtgggggcgtatgatgcgcttactttttcctatgcatctttttcaggaagaggatatacctggcaggatgaaaggacgaaaccggatcttgtggcaccgggagtgaacgtaaggacgacagcagttggcggaggggtgacagtggtgagtggaacttctttcgcaacgccgtttgtgacaggagcatcggcacttttgatggaatgggggatcgtaagaggaaatgatccgtttttgtatggggagaaggtgaaggcgtatctccggcgcggggcgagagagttgccgggatttggaaagtatccgaaccgtgaggtgggatatggacgactctgtttggagagaagcctgccagattaaaatgttatatttataataacacctcgaaaaacaacctgaaaacatatctttattcagttgttaaccttaaatttgttcagttaataggtaaaaagaaaaattatgcaacatgcacaactcaaaactgtatatgcacaaaaataggacgatttgtaaaaaatgctttacgctgatagagtgatagagtatagtgagtttaaacaaattaatattttgaagaaagaaggcaaaatggatggtcagttaaaagtagcagctgttcaagttacagtcgaacaaaataatattaagaaaaatatggaaaacgttgagaaaatggcaatgagtcaacaaaatcgatggagttgaccagagattcgaaaaaaccaaaaataaattaacaagtaaggagacaatgcatgtcagaacaggaaaagaacactgagcaaggtgttcacaagcgccgcacaaggtacaaggggaaatatccacgaaaatttgaagaaaaatacaaagaattacagccggagaaatatcaggacatgattgcacatgtcattcagaaaggaaatacacctgccggaatgcacatttcgatcatggtgcaggaaattcttgacttcttgaagatccagccgggagaggtgggatttgatgcaacgcttggctatggcggacatacaaaagcgatgctgaaatgtctggaaggaaaggggcacatttacgcgacagatgtagatccggaagaatctgcaaagacaaaaaaacgtctggaagaacagggatttggagaggatattttaacaatccgtcttcagaacttttgtactatcgatgagattgcaaaagaagttgggggatttgattttattttggctgatctgggtgtgtcctctatgcagattgacaacccgaagagaggattttctttcaaagtggacggacctctggatctgcgactgaatcaggaaaaagggatcagtgcagccgagagactggatacaatttcaagagaagaacttgccgggatgttatatgaaaattcggatgagccgtactgtgaagaactggcaaaggcaatcaccgaagaaatccggaaaggacaccggattgatactacgacaaagctacgtcaggtgatcgaacagaccttgtctttccttccggaaaataaggagaaaaaagatatcatcaggaagacctgtcagcggactttccaggcacttcgaattgacgtgaatcatgaatttgaagtactctatgaatttatggaaaaactgccgggcactttgaaaccggggggaagagtagcaattctgacattccattcaggagaagacaaactggtgaagaaagctttaaaagcaggatatcgcgagggagtttattccgaatatgccaaagatgtggtccggccttcggcagaagagtgtgcacagaatgggcgtgcaagatctacgaagatgcgctgggctgtgaaggcggagtaaaagtaagtgtaggctgattagaatattgacaaaacaaaaatcaaggatcataatgcggtgcaggaagaaaagtttttaaatgtgttaaaatccagaatggtagatgggatcatttatgtcagttcggattatgcgaccagtaacaagctacttgcagatttatcaatcccagttgtatttattgaccgtaagattgaaaagagtggtaatatgggaagtgtgcagattgataattatcaggctatgaaggaagtcgctgagtatatcagtaaaaaaggatgcaatggatcggattgaaaatattcttggatttaagagatttgagcgtcacgttggataaaaaaagaagagtagaaagatgctgcaaagttatcaaaacagataacagagcggcatcttttgttatttgaaaaatgattaaaatatataacagaaaattataagccgatttgtactttagtctacaaattcagatgccggcgtgatatactgtatggaaaagttatgaaatatctggtatcaaaacggaagcaaggaggaaagaaaaagtatgaacaattttttgccacagaagaggggaatgcaggttgtctggatcatagtgggctgtctgatctacgcagttggtctgaatgtatttattatccctatgaatttatacagcgggggagcagtcggtcttgcacagctgttaagttatggagcaggacagatcgggattaaggaaattgcaggtctgaacctgtatggtatcatttatttactgctcaacattccgattttatttattgcatggtttaaaatcggaaagacattttttataaatacaatccttggaacggtaggaatcagtttatttacttcaatcgtaccatctccggcaacagcagtgatcgctgatcctgtcattggaatcatcatcggtggtgttgtaaccggagccggaatcggaatcatgctgacggcaaaaggaagcggtggtggaatcgaggttatcggtatctggatggcgaaaaaatatgcgggaatgtccgttggaaaactgggaaccatcttcaatctgatactgtatgccatttatcttttagtttttgatatctcaacggtgatttattcggtcgtctacctgttcttctacacggtaactctggacaggatgcattttcagaacatcaatgtgagaatgctgattttcacgaagaagaagggaatcgcagaggcaatcatgaaagaaaccggacgtggtgttacgcagtggaatggtgaaggtgcatttacgagtgaacacaattatgttctggtgacgatcgtgaataaatttgaagtagaagatatcctgaacatggtgtatttactggatccggaagcatttactacggtagatgaaggggttaaggtgtacggaaacttccagaagagagtttaggagagtcaggaataaatgtataaaatactgattgttgaagacgataacacgatcgcagagcggctggcatcgcatttgaaaaagtggaattataagacagtatgtgtacgtgatttcaaaaatgtaatggaagaatttaaaaagacagatccacagcttgtaatcctggatatcgggcttccgttttacaacggattctactggtgccaggagatccggaagctgtccaatgtgccgatcatctttctgtcatcgatgaatgacaacatgaatatcgtgatggcaatgaacatgggcggagatgagtttatcgagaagccgtttgatctgaacgtagtgacagcaaaggtgcaggcggtgcttagaagagcatatgcacttcagggaacggcaaatatcattgagcatggagaaatgctactgaatctgggagatgcatcacttacaatagccgggcagaagattgaactcaccaagaatgagttcaagatctgtcagatgttttttgagagcgcaggaaaatttgtgaccagagatgcgatcatgaccagactctgggaaagtgacgaattcatcgatgataatacacttacagtaaatgtggcgagacttcggaaaaagctggaggaagccggaatgcatgatgtgatccggacaaagaaaggaatcgggtacatgctggtatgacagagattttaagggcattttggaaagaaaaaagaccggagagaatagcggttcttgtttcgggcattctctttgcagtcatcttctggatctatgaaattccggtggagattgcaggatatgcgttccttctggtgattttatggaatgtgatctggtttacacttgttttcatacgatatgaaaaaagacaaagaatactggaagaaaatcagggaaaaatccggacagaggcaggaggatttccggaggcagaaagccgggaaagcgaaatgtaccaggaattgatccggcagctttacgaagagaaaaaagagctggaatcctctgtgcagattgaaaaacaggagctgtctgattattacagcatgtgggttcatcagatcaagactccaattgcagcactcggtgtcctgatccagagcggggaagaactggaagaagtacaggaaagcccgaaagcacaggaacttacccgaagcatgaaaatggaggtgttccggattgaacaatatgtggatatggtactcacctatctcagaatgggttccgcaacctccgattacgccttccggatctgcagcctggaagaaatcgtccgccaggcagtccgcaaatattcccagatgttcatcatgaccagaacaagacttcaccttgaaatccaggatcagaagatcctgaccgatgaaaagtggctgaccttcgtcatcgaacaaattctctccaatgcagttaaatacgcaagaggcggagaaatatcaatctacacagaagacaaaactctggtaattgctgacgatggaatcggaatcgccgaagaggacctcccaagaatcttcgaaaaaggctttaccggttacaatggaagagcaaataaaaagtccactggaataggattatatctctgtaagacaatcatagatcgtctccatcatactatctggattgaatcaaaaccagaaaaaggaacaaaagtatacttaaattttgaccgtgaacatcggcggatagagtaaaaaattcaatcggtgaaagatttagaaaaccttcaacaacggaatcaaactataatttactttttggcagggatcgaccaatcgaaaatgctcatccatttgaactacacagccgccagaaaaaataaatatggaaaattccatgtttgtgcaatggagatgaaacacaggaatcatggaggccattgccgaacatgattcccgtcctaagtggttcatcggaatggtttgcacaaaggaatttggaatatttattttttctggcggcgtctctttcaccaaaataagtcttttccaacccgatccttacaaaaatgtaagaaaccccacacaaattgtcatttacttcgatggaaggaaatcccttacttttttataatgactttatcaaataaaaaagaagggcaggtcataaaaactatggcattacttgacgtaaagaacgtaaaaaagatatacacaacccgtttcggaggaaaccaggtagaggcgctgcataacgtcagcttttccgtagaagcaggcgaatatgtagcaattatgggagaaagcggaagcggcaaaactacacttctgaatatcctggctgcacttgataagccgactggtggaaaggtttacttaaaagggaatgatctcggcaagatccgggaaaaagagatggcagcattccggcggcagaatcttggattcgtctttcaggatttcaaccttttggatacactgaccctgaaggataatattttccttccgctggtcctgtctggaaagaaatacacggaaatggagagccggatcgcgccgatcgcagagcagctggggatcagtaagcttctgaacaaatatccatatgaagtatccggtgggcagaagcagagagcagccgctgcacgtgctctaatcacacaaccgcagctgatccttgccgatgaaccgaccggtgcgctggattccagatcgacggatgaacttctgggactctttaatgcgatcaacgataacgggcagacgattgtcatggtaacgcacagtgtcaaagcagcgagcacggcaaagagagtcctcttcatcaaggatggggaagttttccatcagctttaccgtggcaatctgaccagtgacgagatgtaccagaagatcaccgataccttgacggttctcacaacaggaggtgagcaccgtgaatagatcgatttacacaaagcttgccatttccaatctgaaaaataaccggaagtcatatattccctatgtattgacggccattttaacggtgatgatgtattatatgatggcaaatctggcggcaaattcgccaatgaaccaggaagcattacagatcattttaagtctgagtgttcatgtaattgaaatatttgcactgatctttctattttacaccaacagttttctgatcaaaagaaggaaaagagaaatcggagtgtatcacattctcggaatggggaaaccgcagcttgcgaaaatgctggtgattgagacggttgtaaccggtgcggtcagtattctgggtggaatctttttcggaactgcgcttgcaaagctgatgtatgcacttctgaaaagaatgattcattatgacgataaactggcatttcggatgtcatgggagattgccggaaataccgttctctttttcacgctgatctttgcattgactctgatctataatcttttgcagatccggcttgccaatccgatcgagcttctgcatgcggggagtcagggtgagcgggagccgaaaaccaaatggcttctgactgtggctggcatcattttccttgggatcggttattacattgcgattacgacaaaagaaccacttaaggcgcttcaacttttctttatcgcagtaatctgtgtcattatcggaacctatgcactttttacagcagggagtatagcttttttaaagctgcttcggaaaaacaaaaatttctattataaaacaaagcattttatatccgtatccggcatgctttaccggatgaagcagaatgcagtcgggctgtcaaatatctgtgtgctcagtactatggttctggtgaccatttcgtctaccgtatctttgtacatcggaaaggaggatgtcttaagaacaaggtatccgcaggaagtgtatattacaaattcagtatctgatgatgcggaaaatcagaagctgcacgacatggtagaaaagatctgccgggataatcaggtagagatcacagatgagaagagctggcatatggcagagcttgttaagataaaaaacggagaagaatatacctctgcgatgataaaggattattcgtcattcgatgtggtgttttttgatgtgattaggttggcagattataataagctgaccggcgaaaggttagagcttggggataaggaagctattctttttacaaatggggaaaattatggaaaggatacgatccggattgatgaggaaacatggatggtcaagaaggaactggatactgcaccttttggaaagaagagtgattctaatacagaaaatgtatattatatgatcgtcagtgatgaaaaagagtttatgaaagattatctggaaaaataccagctcgaggcagaggacaaaccggtaaaatggagggagtcattcaatttaaggggcagcgaagatcagaagctgaaagctgtcaaagagctgaaagcacaggcagaaagtgaatttgaacatactggtgtacagggaagatatcttgaaaaagagactttctttggtctgtatggcggtgtgttttttattggaatgtatcttggaagcctgttcctgatggcaacggtgctgatcatttattacaaacagatttccgaaggctttgatgacagagaacgctatcagatcatgcagaaggtagggatgagcaaacgcgaggtcaaaagttcaatacgcagccagatcctgatggtattcttcctgccgcttgtgatggcgatcatccatattgcagttgcatttccggtgatcacaaagcttttatccgtattttatctgaaaaatacaaagctgttcttcggatgcactgccggcacagtgggaatctttgccgtcttttatgtgatcgtatttgtgataacagcaaaagaatattataaaatcgttgaatagaagaaaaagacaaaaaggtgacgaaagtcatctttttgtcgtatatagaggtatttcttgctaagaacgaccgttctgtagtagaatacagatagactaattgaaaaggattgcgagagtgcaaagcacgtagcaatctggtatcaaaggggtcaaaataccttttggtctcaacatcattgaaaagataaaattacagaaagcaagggacgtataaatgatagaaaaagggctggtatatggaagatttcagattctgcatctcaaacatgtggaatatattctggcggcaaagatgcgctgcaaaaggctttatataggaatcactatgtcggatgacctgcacgtatcagggggtgaggaagacaattaccgggtaagacggagcgctaatcctctgacttatattgagcgttatgagatgcttcgtgctacgttgctcagtttcggagtgccgagagaagagtttgagatcatcccatttccgattgacagagtggaatatctggggcagtatctgccggagggtgcggtctgctttatgagtatctgtgatgaatggactgcgaacaatgagaagcgttttgagaagcttggaattccggtggaagttctctggagaaggaccaaagaggaaaaaggggtatcaggttcccagatccggcagaggatcctggcagatgaaaagtgggatgatctggtgccaaagacagtttttgattatgttctttcgcacggaattgacgacaggatcaagttttcaaaataaaggagaagctgaaaatgcaggattgggaaagatttggagaagagatcagacgaaccgtgcaggatgctgtagactcgcaggattatcggaagctgaaccagacgatcacagatacgatcaaccgggcagtgaacggtgcggtaaatggcgcggaacagggcatgcgttcttttggaaatgcgtttgatcaggcaacgagaaatatgggaagaggtccgggaggaccgcgtggaagatatggacagatgggcggggctgacagatggggaagaacgcctggaggaggtgtacctccgtttggaacttacaggtggagcggaacggatggaaatggaagagcatggaatccggatatgcaggactataaggcagaatcacagggcagcagccggtatggctacagcaatgcacagcagtcacctgtcttgtatggatcgacgacgggaacaaaggcaggcggaattgttatgatcgcagcaggcggaagcatagcgcttatatttctgattctgttccttgcatcttgtattgcttctttgccggaaagtccgggggctttatggatcatgcgtgcggtatttggactgtttacggcagcaagtggcatgatcacaggatggggcattaagcttctgaaacaggttggaagattcaagaactacagccgcaggattgcaggcagagagtattgcaatatttcggagatcggaagcaattccggaaaatccataaaatttgtgacaaaggatctggaaagaatgatttctaaaggctggttccgtcaggggcacatggatggtgagaagaaatgcctgatcttgtcaaaccgtgcttatgaagaatatttacagatcgaaacccgcagacagcagtcgaaagcggaagagccggtaaagaaagaagagaagacacaggaaaatacaaaagaaaaagaagcaaagaatgaaaagctggcaccggaggtgcagaagatcattgaccagggggatgcttttatcagaaagatccacgagtgtaatgaagccattccgggagaagagatttccgcaaagatcagccggatggagatgctggtagaccggatcttcgaccgggtggaagaaaatccacagtcagtttcggatatccgtaagttgatggaatattatcttccgacgacgatcaagcttctggaagcatatgaacagcttgacagacagccggttgatggagaaaatatccagactgcaaaacgtgagattgaggcaacgctcgatactttaaatacggcgtttgagaagcttttggatgacctgtttcaggataccatgtgggatgtctcatcggatatttccgtattgaataccatgcttgcacaggaaggtctgaaagaggacggaatgaaaaaataaagtcgcaggaggaagaaaagtatgaacgattttgaagaatttaatgtgacaccggagctgacgctggatccgttccaggaagaaaaaaaagagactccgcagatttatcaggagacagaaccggaaacaccggagatcgtcctgacaccggaagaaaagaatatggtcagtgcatttgcagaaaaaattgatctcgccaattcgaacatgattcttcagtacggagccggaacccagaagaagatcgcagatttttcagaaaaagcactggaaaatgtaaaaacaaaagatcttggagaggttggcacactgttaagtgatgtggtgacagaactgaaaggatttgatgaggaagaggaaaaaggattcttcggaatcttcaaaaaaggcggaaacaagatccaggcaatgaaagccaaatatgcaaaagcagaaaccaatgtaaacaatattgtcaaagcactggaatctcacgaagtgcagcttatgaaagacattgcgcttctggacaagatgtatgaagtgaacctgacatattataaagaattggccatgtatgtgcttgccggaaagcagaagcttgccgagacaagaaacggcgagctacaggaactgaagaataaagcgatggcaagtggacttgccgaggatgcacaggcagcaaaagatctggattccagatgtgaacgttttgagaaaaagctgcatgatctggaactgacaaagacaatcgccatgcagaccgcaccacagatccgtctggtacagggaaacgacacaatgatggcagaaaaaatccagtctacactcgtcaatacgatcccactctggaaaagccagatggtactcgcccttggtgtagaacattccgcacaggcagccgcagcccagagagaggtcaacgatatgaccaatgaactcttgcgcaagaacgcagaaaagctgaagattgctactgtagagactgccaaagaatccgagcgtggaatcgtagatattgaaaccttaaaagcaaccaatgaatcgctgatcgcaaccttcgatgaagtcatgcagatccaacaggaaggccgccagaaacgtcagcaggcagaggtggaaatgcagcgcatcgaagctgaactgaaagcgaagctgttacaggttcaggggtaagcgtttggtggatgacatacaggccggaacaagtagattctgtttttttatgaggagaaagcggtgaagagtccgtaggtaaaaaggcagccggtaattttggataccggactgattcgctgaataatcttgatgattattcggctcagcagtcctctggatttcgtgtatgaaacacgaaaccagatccaaattaccggctgcctttttacaacggactctaatcgtcgctttctaacataaaaaaacagaatttacttgtccctgccttgctgtattccacggggggacgcctggaggctgcccccgttatggggtgggtgcgagtggaggagatgacaggcggtaggaataataggatacttggtgaggagcttcttaaaattaaaagtttgccagcgcacagacataaagagctccgttttctgtgattagaaacggtgctagagtccgttagaaaaaatgcaccagtaattcggatctggtttcgtgctacaagcacgaaatccagagggctgctgagtggaataatcatcaggattattccgcgaatcagcccggtatccaaattactggtgcattttttctctacggactcttcaccatttctacccacagaaaacggagtcctttatgtcgtcccttttgtacatttattcaataacagttccggttttacccttcagagcatctttcagagtatcaaaagaagtaatcagagcacttcttccctctttcttttctatgaatcctacggatgcctggaattttggaagcatattgtagattccgaagtgtccttcatccatgtactgcttagcctgttctacggagatagtatcgagttcttcttcatcttcttttccgtggtttaagcataccttttctacactggtcaggatgatgagttcatcagcatcaatctgttcagcaagcttgccggcagtaaggtctttttcgatgactccgctggcacctttgaggtgattgttctgctggagtaccgggattccgccaccaccgcaggcgattacgatatgtcctgcatcggtaagggtgcggatggcatcaacttctacgatatcaaccgggtttggagaagcaacgacacggcggaagccctgaccaggaacttctactacataattgccctttttacgttcagcggcagcgtcttctgcgttcatgatacgtccgacaatcttggttggtgtatagaatgcttcgtcatatggatcaacagttacctgtgtgataacggtgcatacgctgcgatagatgccgcgtccgatcagttcttcgcgaatcgcattctgcaggtcgtatccgatgtaaccctgcgacatagcagagcagactgacatcggagaagcggtataatccggatgattggtgctgaattcgttcatagcagtatggatcataccaacctgaggtccattactgtgtgtgattactacctggtatccttcttcaacaagatctgcaatggaaactgcagtttttttaacggcaaccttctgctccggaagtgtggttccgagtgcgcggtggcctaatgcaacaacaacttttttcttcatattacatccctctgtttctcagaatttgaattgtctgcgtatgaaaaacatataacgcagacaacagcgataaaaaatatataaaaattatagtatttttttatggaaattgcaatcattagttggcaaaaatgcacagtataaaaaggaattattggtgggcagaagctaaatggcacaaggacggggatttttagaaaacatgctgacaacaaggggagatgttcatataatataataagaagtccgatggatggtgcagtatgaaagaggaacggattcgattttgcggattaaaagagcgtgaggtcatcaacatatgtgactgcaagcggctcgggtttgttgcagatctgcagatcaatatctgttcagggtgtgtggaagcattgatcgtaccgggaccgggaagaatctgtggaattcttgggtatgatgcggagtatattattccgtttgagtgtattcgcaggattggagaggatattattcttgtggaaattaaagaggacaaatgtctgaagccgtgtaaataagaatagtaaaagaggaagaagagtacagactgctcagtgaaataaatgagaacaagtaaaaagacaaaggagagaagaaaaatgacagcattttttaaagaaatcgagccattccggggaaacggaaacgaaaatgaaaagggacagacgctggaagaatttctggaagagtacgatccttataaatataagaatccttgtgtgacaacggatgcagttatattctcctgcaaaagaaaggtagtggacggagaatggaaagttctgatggttaaaaggcggaatcatccgagcattggctggtgggcgctgccgggtgggtttattgaacttcatgagaatctggaagatacggcaagaagagaattgaccgaagagaccggcgtggcggatcttccgatggagcagtttgcagtctatgggaatgtgacccgtgatccgagggcacggattattacatcggcatatctttcggttgtggatgaagggcaggtaaaggtgcaggctggtgacgatgcggcggatgcaaagtggatgcagcttcattgtcagacagaatcggtgaaggaggatggagattggaagagaaccatttatcgactggcattggaaaataaagaagcagagcttacaatttcggcgatcgttgaaaaaaaggaaagaagtggactggtaagagagacttattataaggtaaaagaatcggaccggatcgcctgtgaccatgcggcactgatcgtacaggcatggaagctggtggaaagccggcttatatagccttttgataaagtgtgaatttgttgacaaccctgtatacaggatttatactatagacattaaaaatgtgcgtgattcggcagtagaatcaatcaagaaccaggcaggaggaaaaaagatgaagtgcccatattgtggtaacattgatacaagagtcatcgactcaagaccggcagatgacggaacgacgatcagaaggagaagatcctgtgatgcgtgcaacaagcgttttacaacctatgagaaggtggagaccataccgctgatcgtgatcaagaaggacaacaaccgcgagcagtatgaccgtactaagctggaaggcggagtactccgggcgtgctataaacgtccggtagcggcagcagatattcaggcaacgatcgactcgatcgagacagcgattttcagccgggaagagaaagaaattccgagcagccagatcggtgagattgttatggaaagtctgaaaaagctggatccggttgcttatgtacgttttgcatcggtatacagggaatttaaagacgtgaataccttcatggatgaactgaagaaaatattagaataaaaggggaaagacaaatggaacggaaaaagacagtattgctctgcgtgaccggcggtatcgcggcgtacaagattgcaacactggcaagtatgctggtaaagacaggatacgatgtgaaagttgtgatgacacagaatgcaacgaattttatcaatccgctggtatttgagacgctgacacagcataagtgcctgatcgatacatttgaccgcaattttgagtacagtgtggagcatgtgacactggcaaaatgggcagatattgtgatgatcgcacctgccacggcaaatgtgatcggcaagctggcacacgggattgcagatgatatgctgactacgactgtgatggcatgtgccgaatgtaagaagatcattgcaccggcgatgaatacaagaatgtatgagaatccggtcgtacaggataatttaaaacttctggagcattatggatatgaagtgatccagccggcaagtggacatctggcatgcggagataacggagccgggaagatgccggaagcggagactttgtatgaatatatttaccgggatactgcttatgagaaagatctgaccggaaagaaaattcttgtcacagcaggaccgacaagagaagcaatcgacccggtgcgctacattacgaatcactcatccggtaagatgggatatgctcttgcacgcgttgctgtggcaagaggagcggatgttacgcttgtcaccggaccgacagagatcaaaaagccgatgtttgtgaagattgttccggtcacgactgcaaaggaaatgttcgaggcggtaaaggaagaggcagcagatgcagacattgtgtgtaaagcagcagcggttgcagattaccggccaaagcatattgcggatgaaaaggtgaaaaaatcggacagtgagatgagtctggaactggaaaagacagacgatattctgaaatatctcggagagcacagaaaagacggacagtttctgtgtggattttcgatggaaaccgagaatatggttgaaaattccagaaagaagcttgaaaagaagaagctggatatgatcgcggcaaataatcttaaagttgccggagcaggatttcagggcgatacaaatcagatgacgctgatcacgaagaaagatgagactgcacttccaatgatcagcaaggaagagacagcagcttgtattcttgacaagattctggagtgtatgaataaataaaaagccaaaatgtattgtatctcgtaaagagaatagtaacaggaggaaaagaaaaatgaatcaaggcaatgaacgtactacatctatgtccaaaacaaaaggactcgtacagatggcaatctttgcagcacttattgtagtgctggcattcaccccgtttatcggatatatcccattgggatttacaagggcgacgatcatccatatcccggtgatcatgggatctctgatgcttggaccgaagaggggcgcagcgcttggaggcgtgtttggtcttacaagttttatcaataatacgataaatccgacattgacatcattcgtatttaccccattttacagtttgggtgaatacagtggagggatcggaagtctgatcatctgttttgtgccacgtattttgatcggtgtagtaccgttttatgtttaccgtctggttaagaagctttcaaagaacaatggagtatcctctgttggactgattgcggcaggactttccggagcactgaccaatacgcttcttgtcatgaatcttatttttgtatttttcagaaatgattatgcggcagccaatggtattaccgtaaaggcggtatatggatttattctgagcattatcggaatcaatgggattccggaggcgatcgtagcggcggtgatcacgctggtacttgggaaaacactgatgaaaaaaggggtacaggaaagattaggagtgtaaaatatgatacttgcgattgatataggaaatacaaatattgtacttggatgtgtggatgacaacaaaacctattttatcgaaagactttccacgatcaagacaaagatggaactggaatatgcgattgatatcaagatggttctggatattcacggaatcaaaccggagaagctggaaggagcgatcatcagctcggtagttccgcagattacatatgtcgtaaaagaggcggcagaaaagattctgaaaaaagagacactggtcatcggacctggcgtgaagaacggactcaatatcctgatggataatccggcacagctcggaagtgatctggtggcaaatgcagttgccggaattgcagaatacaaagcaccgatgatgattttcgatctgggaacggcgacaacagtcagtgtgatcgatgaaaagaaaaattatatcggaggcatgatttatccgggagtgaatatttcactgaacgccctgacggaaaatgcatcccagcttcagggaatcggtctggaagcaccgaagcggattgtcggaaagaatacgatcgaatgtatgaagagtggtgttctctattccagtgcggcggcaatcgatggaattattgaccggattgaggaagcgattggacagccgatgactgcaatcgcaacaggtggactttccaagaagattgttccgtactgcaagagagaggtcatactggatgacgatctgctcctgaaaggactcctgatcatttaccggaaaaacagataacagaaaggtgatagggacgaggacttataaagttttcgccccttttataaaaggatgaatacttaccggataacagttgcctatgatggaacggcgtatcgtggatggcagagacaggagaatacggaacttactatacagggaattctggaacggcggatttcagaaattgcagggaaaaagacggtggtcagtggttcaggaagaacggatagtggtgtacatgcgttagggcaggagtgcagtctgtatctggaacaagaaattgatatggacagttttaagaagcagttaaatgcacttctcccggaagatatcagagtgctggatatcagcagagaaaaacgggattttcatgcaagaaagagtgcggtcgggaaatgctatgagtatcagatcgatctgcgtgacaagatggaagtatttcatcggaaataccggtttcattttccacatccggtcgatatcgctgcgatggaaaaagcagcagagtatctgatgggaacccacgatttttccgcctttacggatttgaaagaggacaaagatacggtacggacgatttatgcggtcgggatcgtgtatgaaaaggatacacttacgttatcgtggatcggagatggatttttatatcatatggtccggatacttaccggaacgcttctggatgtgggaatcgggaaaataaaagcggaagagataccggagattctgaaagcgaaagaccggaagaaatctggttttccggcaccggcgaagggactgtttttaggccgtgttttttatacagaagcggagcttaaaaaagcggtacagaagatcagcgaaaaataaaaaccaaagaaatggaggaaagagaagagatgaagtttatttcatggaatgtaaatggaatccgtgcatgtgtgcagaaaggatttatggatttttttaaagaggcagatgcggatattttctgtctgcaggagacaaagatgcaggaagggcagcttgtacttgatctgccggaatatcaccaatactggaactcggctgtgaaaaaaggatactcagggactgcaatttttacaaagaaagagccgttatcggttacttacggacttgggatagaagaacatgatcaggaagggcgcgtgatcacactggaatttgaggatttttattttattaccgtgtatacaccgaactcccagagcgaactggcaagacttgactaccgtatgacctgggaagatgcgtttcttgcttatcttaagaagctggaagagacaaaaccggtgatcttctgtggagatttgaatgtggcacacaaagaaattgatctgaagaatccaaagaccaaccggaagaatgccggatttacagatgaagagcgagcaaaattctcagcacttctggatgcgggattcattgatacttaccgctatttctatccggataaagaaggaatttactcctggtggtcctaccggtttaaggcaagagaaaagaatgcaggttggcgtatcgattacttctgtacatcaaaagcactggaaagcaggttggaagatgcgaagattctgacaaatgtatttgggtctgaccactgtccggtggaactggattttaagtaggggtgagatcgataagctgcgacatcaaattgtaaaaaaataaactgatcagattcacttttgtgcgatggaatctgatcagtttatttttttgaaatttttcgttcagggatagtggatgattctgtttgagggaatatataaaattctgcctgcatataaatatacatgggtaatttagcttttgggatgaggagggacatgtatggaacggattggaagtatctggacgatgatagttcggtatttgctgctggtgatctttggtggagtgattgtctgggcgtgcaatagtgcaggaatatcggtttacgcagatgatggggagacaccggatggagcagagctgatccggtttgattttcacaagtcggtaaatcaggaggttgggatcccggcaggaataccaggatttttcacttatttttatgaaggaaaagaataccattacggattccggtttgacagaaatgggacagggccagagacagaaaagtttggtacggcatatgtctgggcaccttatacggttatttattatgacgctgcaggtggtgagatcgagaattacggtacggcaacagcaggcggaagaaggctgtttgcgacaaggggaaatggtgaagagcttgaagccgggcagaataaaggaaagaacaaaagaaaatttgcggcagactatactgtgtatgggcagagtcttcggttaagtgaaggatgtatgccaacggcagtgaaagacggatatcgatttgaaggatggtatgcgtggactgatgctggagttgtgcaggaaaaagaactggcagagcttgcaaaacaggagcagtatgggacacttgaagatgagctgaatgagaaatatacggagcagacaaagcttctggaaaaccgggaatccgaaagatacccggcatccagtattacactttacgcgaagtgggacaagatctgggagtaggagttagatatatcctccgtccatacccagtatctgcccggtaagataggcaggggcatttgcaagctgccatgcgagaagcgcgacttcttctggtgtcccgaaacgtccggcagggatttcttctgcgagggcagctttttcttccgcatccagaagatcgttcattacggtatcgatgacaccacaggcgatcgcattgacctggatattgcttggcgcaagttcctttgcaagtgcgcgggtaagaccgttcagaccggatttggtggcagaataagcgacttcacaggaagcaccgacagttccccacatcgaagaaatattgatgatacgtccagctttctgatggatcatgtaaggaagtgctgcgcggcagcagtaaaatgcggaagaaagattagtggaaatcattcggttccattcttcaatgctcatatccgtcagaagtcccatccatgcgattccagcattgttgatgagtacgtcaagaccggagccggacatttcaatctggtcaaagatacgtccgacttcggatggaacacctacatctcctgggaggatttcgcaggaaccggaggtttcctttgtgataaaatcagcagtagcctgcaattcactgatggatttgcggcagtttaaaaatacatgccatccctcttttgcaaagtggatagcgcaggcttttccgattccacgggaagcgccggtgacaagaatctgttttctgttcatttataaaaactccttttgctatgtataagaattactttacagttatttttttctacataatcagacaatattatacactgattttcttgtgatttaaagacgctggtgttatgataaatattgaaaaaatgtcatacagatgcgaggaggaaaaacatggtacagaaagccattgattttgccaccaaggtacatgaaggtcagtatcggaaggggaccgacagaccgtatattgtacatccgatggaagtaggaaagatagtatccacgatgacacaggatgaggagatcatcagtgcagcaatcctgcatgatacgatcgaggactgtgagggtgtggatgcaaatgtgttaaaagagatgttttcagcaagagttgcgggaatcgtatcacaggaaagcgaagataaatccaagacctggatggaaagaaaaagtgcaaccatagaaaggcttaagacagcaccaattgaggttcagatgatcggacttgcggacaagctgtcgaatatgcgggatattgatcgggattatcctgtatgtggggaggaattgtggaacagattccgaatgaaagacaaagcaacgatcggatggtattataaaggcgtcagagaagcattacgggaagcatttgcagagacggaagcatttgcagaatactgtagtctgattgacaaaaattttggataataatgaggtagaagagaggaaaatcaaagatgaagaagattttgatgttaggtacaggtgggacgatcgcatcccgtcagacaaaggatggactggcaccgggactgacaccggaggatattttatcttatattccggctgtaaaaaatgtatgtgaggttcagacaaagcaggtgtgtaatcttgacagcacgaatgtaacaccggaacactggaaaatgatggtaaaagcagtggaagacaattatgcatattatgatgggtttgtaatctgccacggcacggatacgcttgcatatacagcggcggcactttcttatatgatacagaattcagccaagccgattgttgttacaggagcgcagaagccaatcaatatggatgtgacagatgcgaagacaaatctgctggacagctttatttatgcggcggatgatgattcccagggggtcaaccttgtatttgacggaaaggtaattgtcggaacacgtgcaaagaaagagcatgcaaagagttacaatgcattttcgagtatcaattttccgtatcttgcagttattcaggatggtatcctggtccggtatattccggagattccgtgccgccatgcagttaagttttattatgatatgaaagacagtgtatatgtattaaagctgatcccgggaatgaagccggatattctgtcctatctgtttgaacactatgactgtctggtaattgaaagctttggcgtaggtggtattccgcagacgcttgttcaggaattctatcaggagatggaaaaatggtcaggtaagggtaaatttgtcgtgatgacaacacaggttgccaatgagggaagtaatatgacggtctatgaagtcgggaaaaaagtgaagcaggatttcaatatgatcgaagcctatgatatgacactggaagcagtgatcacaaagctgatgtggctgatgggaagagaagaacaggatatgcagaaagcattctacacgcagatcaatcacgatatcctttttacaaagagaggataaagcaggtgcaaataaaagaggaagggttccggatgaatggaacaccttcctctttttgaatatttaattttctccggttagattttttcaaagtcgccaatcatgtctttgatctcttccatgtggcagtcagtctcgcttacagtttgtgcacatttcaaaagttcggcttcgatagcctcgatatctttgtcagcaccgattgtttttttgtaacgaagctgatgatctacacttgcccagaaatccattccgatcgtgcggatctggatttcggcgcgcattggaaattttccctctgtaaagaaaaccggaatctcaacgatcatatgatagcttcgataaccgtttgactttggtgcttttatgtagtctttgatcttaagaacagtaatgtcatcctgtgaagtgagcaggttggcaattgtataaatgtcactgataaacgggcagatcacccggattccggcgacatcgtccaaattcttgacgatactatcctctgtaaatggcagatcacgtctgcgcagcttttcatagatgctggcaggactttttacacgggatttgatagatgagattggattgcgtttgtttactgcagaaaactcatcatccaggacttcaagctttgtctggatctcgcggatcgcacagcgatacttcatcatcagaacatcaaagttcttattattattgataaaatcagccggactaatcgcatttagccactgtgattccagtgcagtcggatgctcagaagccggaatcagtttaagttgtgtctccatatgattactcctctttattctggttgcttatattattatagcatatctggggtaaggtgcatagcatacagagtacggaaaatgtcttaaaaatgacaatcttttaaatgctatggaatccttttccgataatctcgctggtgttggaaatcagaataaaggaagaaggatccttttccttgataaagttacggagtttgattgcctgctgacggttcagcgctgtaaaaataatgtatctctgttcaccggtaaaggctccgtgtgcttcacagattgtggcgcctcgaccgagtgagtggacgatataatcgcagatcggttccggattactgcagacaacgttgaaatatttggaaaggttcagactttcaataaagctgtctacaaggaaggaacggatgatcagtccgaaacaggaataaagtcctgtttttacgtcgaagataaagaaacctgcaacggtgattgcaatgtcggagcaaaccagtgcacgtccgatgtcaacacttgtaaatttcttcaggatcatggcaataatatctgtacctccactggaagatccgatattgaagaggattgcagaaccgagtgccgggagtgcaattgcaaacattacctcaagcataggctgattggtaaatggctggttcattggaaagattcgttcaaataaagaaagcgcaacagaaagcaggacactgcagtaggctgtctttgcaacgaattttttaccgaggatcactgcgccaagaatcagaagtgacatgttggcaacgaatgaaaagtcggcagcagaaataagtccggttttggcaatcagtacggcaagaccggtgattccgccaaatgtgaagttgtttggaaacttaaaaaaataagttcctactgcgatcagcagagttgctccgctcattgcaataaaattttcgattttttctctcattttatattccccgattgattcataaagttttagaaaacggatgaaatactgaaaaaatatcacccgatttccgttggtattgtaacgccgaaaatgtatgaagtcaaccgttttagagcattttcgtaatgtatacgatgatacgaaaatacggggattttcgtgcatgattcagcgcccgaaaggacatactaaaagacaaaaaaggaggatggattatggaacaatatataccggttacagatattattgcgcgggaagttctggactcacgcggaaacccgactgtagaagtagaggtacttgcagggagtcattttacaggaagggcgatggttccttccggggcatcgacaggaaaatatgaagcaattgagttaagagacggaaaacaccgctatcagggacttggtgtcagacgcgccgtggagcatgtgaatgaccggatcatccgggaaattctgggaatgaacgtgctggagcaggcgaagctcgaccggatgcttctggagcttgacgggacagacaataagatcaatctgggagcaaatgcaatgcttggagtgtctcttgcagcagcaagggcagcagcagatgcgctggagattccgttgtatcagtatcttggcggtgtaaatgcaaagcagatgccggttccgatgatgaatatcctaaatgggggacggcatgcggataattccattgatctccaggaatttatgatcatgccggtcggagcagtctgctttgaagaaggacttcagatgtgcgccgagatctataagatgcttcgggcgattctggaaaagtacgattatccgaccgcagtcggggatgaaggtggatttgcacctaatctgccggatgcgaaagaagcactacacatgatcatgcgtgcgattgaaaaggcaggttataaaccgaaagagcagattgtgatcgcactggatgctgcggcgagtgagctgtatgataaagagagaaaagagtatgtatttccgggagaggcgaagatgcacggacatcgtgtggcgcgatcgacggaagagatgattgattactatgaggagcttgcaggagaatttccaattatttccattgaagatccgcttgatgaagaagactgggaaggttgggagcttctgacgacgagactgggactggatatgcagcttgtcggggatgacctgtttgtgacgaatgtgaaacggctgaacgccggcattttaaaggaaatcgccaatgcaattctgatcaaggtgaatcagatcgggactctgacggaagccatcgatgcgatccagatggcgcagaaggctggttatcaggcaattgtatcccaccggtcaggagagacagaggatccgtttattgcagaccttgcggtggcatttaacacgggacagatcaaaaccggagcaccgtgcagatcagaacggatcgcgaagtataatcagcttttgaggattgaggagaagctgggaaatattgccagatatgagaatccatttgtacgattttcataagatttccggaaaacccagccttcgggcaggaggtattgaaaataaaagcagtgcatgatattatgcagagtataagaatgggaaaagggatcactttctaagcgaacagggagtgacctcttttcgtgaggatattaaaaggagaactggaaaatgatcagaaaaataaaagcagaagacaaagaaatctacataaaaatggcgcatgatttttaccggatgccagcagtggatcatccggttccggattcttatctggaaaagacatttgaagaatgtctgaaaagtgatacctatgcggaactgtttatcctggaatgggaaggcaagatcgcaggctatggactgatcgccaagaccttttcgcaggaagcgggcgggatggtgtactggctggaagaactctatatattagaagagtatcgttccaaaggacttggaagtgagtatttcagatatatggaagagcaaaaagaagagggtgtgacaagattccgtctggaagtggaaaaggagaatgaaagagcctggaagctgtataagagacagggctatgactggctggagtatgatcagatgataaaagaattttgctagaaaaatgtcagaaaaaagaagaagaagtacttgaaatgactttctttaaaaaaatgtaaaaaaatgcttgcatttccgtaaagatttgctataataaatttgttcgctgttgagaaccagagcgaacaaacagatgatgcggattggtgtaatggcagcacagcagactctgactctgttagtagaggttcgagtcctctatccgtagttccttaattgaataaggatttagccggacagttagttgtccggtacggttatcggagtgtggctcagtttggtagagcgctacgttcgggacgtagaggtcgcaggttcaaatcctgtcactccgatttggttttctgaaaatttataatgttttgttcatttcgatggacagagattaacagatgattgatgcggattggtgtaatggcagcacagcagactctgactctgttagtagaggttcgagtcctctatccgtagtttttaattgaataagaatttaagttggatattccgtttggaatatccaatatatttattatcggagtgtggctcagtttggtagagcgctacgttcgggacgtagaggtcgcaggttcaaatcctgtcactccgatttttgtatgtctgaagataagaatctcttttgatgcagatgtggattgaagaatccggctgtgtcagaagagatttttattctttcgtaacattgtacgaaaaggtgatggaatcacaggaagagttgtgataaaatcgggatagagctgcttttggggaaaagaatatgattctgacaggcagaggaaaaagattggaaagaaggaaaagatgatggaaaaattttcagagatgaaatatgtacgtccagatggggaagcgtatatccggaccatccagaaagaaacaaagaactttaacgaggctgcagattttgaaggcgcgcatcaggcatttgtcgcaatcctgaatgcaaacagccactttaatacgacacgcgtcatggcaagtatccgcaacagccaggataccaatgatgaattctatcgaaaagagatggaatatattttcgagatcgagccacagattgatgtcgaaatgaaaaagttctatgagagttatctgaagtcttcttacagaacagagcttgaaaaagagtttggagaagtttattccagacaggcagagaacaaagtccggcttaccgatccgtgtaatgccgatctgcagatccaggagaacaagctggttcagaagtatttccaggttgcagcggcaccggttacagattttcacggagaacagcttggattctatggtctgttaaagatgatggaggataccgacagaagcatccgtaaagaagcatttgaaaagtgggcagagttgtataaagcgatttcggatgaactggattccctttatacggaactgatcggaatccgtcagcagatggcaaagaaccttggatttaatggatatgccgagatgatgtatcagaagatggaaagatttgaatacacgccggaagatgtagcaatatttcgtaagcagatcagggagcatatcgtaccgctttgtcagaaactttatgaggaacagaaagaaagactcggtatcgaagaattaaaatattatgacgaaagtcttacctatccggatggaaatgcagttccggagggaacggaagaagaacttctggaaaaggcgagaaccatgtatcatgaactttccaaagagacaggagaattctttgattttatgatggaatactgtctgtttgatctggaaggaaggcagggaaaacagcagggtggctactgtgactttatggaagaatataaggcaccgttcatttttgcaaactttaatggaaccaatgcagatgtcaatgtccttacccacgaagcaggacatgcctttgaagcatacacagcgtcacgtaatattccggtattatcgcagacatacagtaccgcagagatcaatgagatccattcaatggcgatggaatatttcacactgccgtggatgcatctgttcttcggagaaaatgcagaaaaacagaaaaaagcatacctgtgggattcgctggaagcaatgccatacatggcatgcgtagatgaattccagcaccgtgtatacgctgaaaatctgaccgatgcaatggaaagaagaaaagtatggcacgaactggaaaaaatctatctcccatggagagattatgatggcaatgaattcctgggacagggcggattctggatgcagaaacagcacctattcatgtgcccgttctattatattgattacgccgtatcccgtgtaggagccctcgaatactacggaaaaatgcaggaagacctggaaggcgcatggaaagattactacgccctctgcagccagggcggaagcaaaggctaccacgaactcctcagaatcggaaacttaagcgacccattcaaagaaggaaccatctacaacgttctgaaaaaattgaacctgatttaagcgaaagaaaactgaaaaaacatgatatcgattacataatcttattgcatgtactggagggacaaggtataatttgcttataagagtatgggatcgaagattattatcgataaccttgatggacgaattacgcaaaagaactgtttcaaattctaattttgtgcaatggagatgaaactcaaaaatcgtggaagcctctgctgaacacgattttcgtcctaagaggttcatcggaatggtttgcacaactgaatttaaaacagttcttttgtgtaattcgtcttcacagcctataacttcgcatctaagaggattataaagagaggaatcgaatatggaaaagatctatgacgtaaccgccttaggcgaactgctaattgattttacagaaaatggaacaagtgcacagggcaatccgcttctggaagccaatccgggaggcgcaccatgcaacgtactcgccatgcttgaaaagcttgggaaaaagaccgcatttatcggaaaagtcggaaaagatatgttcggagaacagctgaaaactgcagtcgaagaagttggaattgatacacggaatctggtaatggatgaagaagtacataccacacttgcgttcgtacatacttatccggacggtgacagagatttctctttctaccggaatccgggagcagatatgatgctgaaaaaagaagaagtggacgaagatctgatccgcggggcaaagattttccatttcggaacactttcctctacccatgaaggcgtgcgagaagcaaccagatatgcgattgatgtggcaaaagaagcaggatgtatcgtaagttttgacccgaacctccgcccgccactctggaaatcactggatgaggcgaaagccgagatcgaatacggactttccaaatgtgacatcctgaaaatttcagataatgaagtggaatttttgttcggaactacggattatgatgagggagcaagactgatccgtgaaaaatatcagattccgttggtactcattaccctcggaaaagacggaagccgtgcatattataaagatctccgggtagaagttccgggctttgtccaggagcatacgatcgagacaaccggcgccggagatacgttctgtgccaattccctgaattatattctggagcatggaatggaagagttgaccgaagaaaatttaaaagagcttctcacatttgcaaatgcggcagcatccctgatcacaacaagaaaaggggcacttcgggttatgccgaccagagaagaaatcaagaactttatccagaatgtataaaaaaggaatctgttgtaagacagaagagaagaacctctgcttgacatcttgtccggcagaggttcttatgtgcatgctataatatttattttttcttattccagacatggatgcctgcaaggattccaccaatatacaggatactgatgagtaccgtcggattctcatgcagactgtatactacagctacaattgcagcaaggatcactgtcagcataaaggcattcataatccgtttttcgcggatgttgcgttcctgcacctggagctcatgacgcttttcttcaagcttcagatactcaagaagctggtcatccggaattttttccaggatatatttttcacgcagatagttcagttcttttgctgtatggaaaatgtggtggtggaaacttttcttttctccggtaaacggatctttttcggaatcgtcagaagatttgaaatcttccgatgaaaaatccgtgtaagtattctttttttcctcagatgaaatggtttctgcttcaggggaatctggttccggagctggagcttctttgggtggtacatcagtggctgtatggatgtctccggattcggaaactggttctgtagaaagctttggatcagaatcggcagattctgagaaagctaaaatttcagacatatcttaacctccttcgatcatgaaaatgatcgattttcttttcttatagaataccagtttcgtataaaaatttcaatcgacagcgagaaggaaatgtctgctgaggattataagaaaatctcatttggctttcgtccagataacagatttttcattttcagagatgcggcagccaaaaagacagggtttagcttccggataccttttggacaggcggcgatacatcccatacaactgatacatttgctgctatcgccggttcggatattatttttattgattgcacctgtagggcaggcttcggcacattttccacagccagtgcaggaagcgtttgcttttggaacaacactcaggttgccaaggcgtttatactcatgactgccaggcacgaaataatcagtagacaattctttgtcagaggaaagtttttcgagtatttcttctgcaaatttctttaactctttgctatcttcttcgtctggtcgtccactgccgaattggcgcatgatagaatgttctgcaacagctgcaacggaggcgataacattgaaaccgcataactcggcggtatcttttaactggatcagaccgtcatcatatgcacggtttccgtaaacagcgataactacgcaatttgcatggttcccttgtatctctttcatcctttcaatggcgatatcaggaataacgccttcgaatacaggagctgcgatgacagcaagtgaatcagaagggactgctacatctgaaaagctgacatcgtgccggataagattcacggtatttgtaatatttcccagatagcagctgatcaggtctgcaacttttttggtccctccggtaggactaaatgtaatttctacaactggatatgttttcattttttctcctttggtgtaatttttgaatttacaacaagactatcatttcatagatgtaatgtcaatatttacacctatagaaaaatatgataagctaaaatgaaatcaaaggaggaagtcagagtatgcagttatcaataagggcatcgcttgcaattcattgtctaatactggtcagcgaatttggagagacggataagatcacaagtgaaaagattgctttatcaacgggaacgaatccggtagcgatacgcagtatcatgagtgctttaaaaaaagatggaatccttaatgtgaaaaacggtaccggtggaacgactttaaatatgccgccggaagaaattacagtatacagaatctgcaatgccgtgaaaccgcagttctgtaaaaatatatttcacgtacataccaaagcttctaaattgtgtccagttggacgtaacatccgggcagttttgcaacactcctattctaaatttgaatctgcattggaagacagcctgaagacagttacgcttgcagatatgatctgggattatcatatgcagctagaaaaagagaaataatctttgtcagttggaattgtcaaaaaaagaaaaattttctataataaaaagtggaataaggatgtgtatacagcattttttatttaacaggaaattctgaaggaacttcctgttaaataaaaggcaccgtgtgctggagatgcgcactcgcgcgaagatgaaggatgtcgcaagcggtctacgctccgcgtcggtcgttgcttaacgagcgccactggcgctcagcaacgcactcggtgcgagaatgtgccaaggtacattctttttttaagaaaataagagtacgaggaacaaaggatgaatgaaaaattaaaagaaatgagagaagcatggaaaaatctgtatggttcattgttcaaatggatcgttttgtccggggtgatcggaagtttcatcggactgatcgccagcggattttcctatgcgattgtatgggtgacttcgtttagacaggcaaatccgatgatcattcttgggctaccgttaggaggtcttttgatcgtctggatgtacaaaattaccgggcaggagaagaactccggaacgaacctggttctgacagtagtccggtcggatgaggaagaggttccgggatgggtgacaccactgatcctgatatcgacagcgatcacacatctgtttggaggatcttccggacgagagggtgcagcgcttcagtttggagcaagtgtaggaaatgtatgtgcgaaatatctgcatttgaatgagagtgacaagaagatcatcattctggcaagtatgagtgccgcattttcagcacttttcgggacaccgatggcggcggttgtatttccaatggaagtgatcagtgttggtgtgatgtattatgccgcgctggtgccatgtgtattttctgcatttgccgcacaggggattgcgctgcttctgaaagtgaggaccgttactccgccgtatttggtagaatcggttccgaatttttacagtgtggattcgatcaaagcgatcattctggcaattgcgtgtgcgcttgccggagcactgttctgtattgtgctgcataatggggaacattatctgaagaaatggtttccgaatccgtatgtgcgtgtggttgcaggagcagcaggagtgatcattttgtattttgcactcagaacggatgcctatctggggcttggaacaggtgtgatccaggcaagctttaaagagacggcaggaccacagatgttccttctgaaaatgctgtttacggcactgacgctctgcgccggattcaagggtggggagatcgtaccatcactgtttatcggggcgacacttggttcttttatgtctacgatccttgcagcaccgacagatatctgtgcggcatgtggaatggttggggtcttttgtgcagttacaaacagtccgatcacatctcttttgattgcagcagagttgtttggatttaacgggatgccgttttactgtattgtggttgcggtaagctatctgctttccggatattacagcttatataaggaacagaaaattgtttattccaaaacagagaataaatacgtggataaacatacgaaataatcaaaaaacaaaaagaaacaaagtgaattgatgattttaaagcaaaaaagctgacaattaacgagaaaaaattaaaaaatagaagaaaatacttgaaaaagtaaagaacgtgtgctagtatctaaaaataatttagtaaagcaaagcgatgaaagagactcttgcttctggaacttgacaggaatacggcgtcaccgactgagagcgctgtttgaggaatgaggcgaagggaacactctggagcagattatctgaatggaaagcacaggcgctttagtagggtaatacggttcatgcacgttacgtatgtaagagaggaatcccaaaggattcaatgcgggtggtaccgcggatcatcagattatccgtcccggaatacgaaaaagtattccggggcttttttattgccatgtacatcaaaaaacaatccggaatacgaagttgacaaaagcaaaacatattttaggaggattgtgacatggaatttatgacaggtgtaaaagaaaaagaaacgctggaacttagtgaattactggaagagggaagacttggagaagaagtgaaggtaaatggagccgttcatacaattcgtgacatgggaacagtcgctttcgtgattctgagaaaacgggaaggtctggtccagtgtgtatacgaagaaggcgttataaaatttaacttgaaagatttaagagaagccgctacagtagaagtaacaggaaaactgaccgaatcagagaaggcaccgaacggaattgaaatccgtctgagtgagataaaagtactcagtatgccaaaagacagccttccacttgctgtttcaaagtggaaactgaacacttccctggaagcgaagctgaactatcgttccatttctcttcggaacgtaagggaaagagcgaagtttaaaattcaggaaggaatcgtaagaggattcagagagttcctgtataaagaaggttttacagaaattcataccccgaagatcggagcaaaaggagcagaaggaggatctaacctcttccgactggattatttccatcgtccggcagtgctggaacagagtccacagctgtacaaacagatgatggttggtgtttttgacagagtatttgagacaggaccggtattcagagcagaaaaacacaacaccaagcgtcatctgaacgaatataccagtctggattttgaaatgggttatatcgacagctttgaagatatcatggcgatggaaacgggcttccttcagtatacgatggagcttctgaaaaaggattatgcgaaggaacttaaaatcctggacgtgacacttccggatgtctctaaaattccggcaatccgttttgatgaggcaaagcagaaggtttcagaaaagtacggacgtaagatccgcaatccatttgatctggaacccgaggaagagcatctgatcggacagtacgcaaaagaggaatgggattctgattttgtatttgtaacctactatccgtcaaagaagcgtccgttctatgcaatggacgatccacaggatgagaaattcacactcagctttgaccttttgttccgtggacttgagatcacgaccggaggacagagaatccatgactacgacatgctgatggaaaagcttgcaaagcggggaatgacggaagaaggactggagacctatctggatacattcaaacatggtatgccgccacatggaggtcttggaatcggaatggaacgtctgacaatgcagcttcttggtgaagataacgtccgtgagacaaccctcttcccgagagatttaagcagacttactccgtagagacgaagctccatggctggcaggtaaaaaaggaagctgacaagaggcagcgggggaggtcaaaatgagacgaagatgtttcttatgtggaggaaaattaaacggaaatatctgcacagagtgtgggcttgacaattcaaagaatgacgatcagtatgtgacacttggaaattccggtcatgaagaatcgctgacacatatacatacggaagcggaaaagccgtatgaaggaaagaccatgactcgggaaaatgtgcgtaaggcgaagaatgcagataaaaatgcaaagaaagcagctgcaaaaaaggcgtcaaagaatgcggcagcaggaaaagtaaatccggcggggaatggatattctgcagcaaatgcgagctacaataccacaggcacaagctatagccagacaggaaaccagagttacagttatacatcatcttcaatgaaacaaagcagcagaccggtaaaaaagaaaaggaagcttggaaagtttctgatcggttttgtgatcattgcagcatttgcaggtgagcttggcggaacgatcagcgatgaagttcagcattattttgatgactatacttatgatgacagtgacagctacaccgaggaagatccatacagtgatttgcaggaagtgatgccggaagaaggagaactttatgaagcagacctgacagccggaatttataaaggcggtgtacatcttccgcagggaatctatacactgacctgcaaaagtggaagtggtcaggtagagctgacagacagcaaaaataatatctgggtgcagtacaattttggtgatgactacgataatgcggaagaagaagtcagtgactttgaagtatttccgggatgttatgtgatagtagaggatacactggagcttcacatgacagcagagaatgcacagatgaatctgacagcaattgcaaatccgcttacagaatcgaaaaccgtatcggataaatttacagtaggaaaagacgtacctgcaggtgtctatgatgtgaaatgtgtggaaggttttggaatttttgattatgacgtgacagtaagcgccggatacgaaaactatatgggaatgctgatcggtaatgaagagtcgggatttccacaggagctgaaaaatattgtcctgatcgatggaacagaagttgatctggaaggacttacagtagaacttacaccgagtgagtggattgaatcggaggagtacgaaagcttttacgataattattattagaaaggacgagtacaatggcaaataagatttcggatgaaacaatcgaatacgttggaatcctggcaaagctggagctttctgacgaagaaaaagagcaggcaaagaaagatatggaaaccatgcttgattatattgataccctgaatgaactggatacagaaggaattgaaccgatgtcacatgtatttccggtaaataatgtattccgtgaggatgtagtgacaaatggagacaatcacgaagcaatgctggcaaatgcgccgcagcagaaagaacagagctacaaagtacctagaacattcgcataggaggaaatcgaaagatggatttgaaaagtcttactgccgttgaacttggaaaaaagattcaggcaaaagaagttacagtaaaagaagcagtggaagcctgcttcgcacagattgataaagtagaaaaagaagtcaacagttttgtatcacttcaaaaagaagctgccttaaaaagagcggaagaagtgcagaagctgatcgatgacggaacactgaccggaccgcttgcaggagtaccggttgcaatcaaggataacatgtgtacggaaggtgtgacgaccacctgcagttcaaaaattctgagtaattttgtaccgacattttcagcagaagcagttctgaatctggaaaaagcaggttcagttgtgatcggaaagactaatatggatgaattcgcgatgggaagcacgactgagacttcttattatggagagacaaagaatccgtggaatctggagcatgtaccgggtggatcttccggtggctcctgtgcggcagttgcggctctggaagtaccatatgctcttggatctgacaccggcggatcgatccgtcagccaagttcttactgcggaatcgttggaatcaagccaacctacggaacggtatcccgttatggactgatcgcttacggatcatctcttgaccagatcggaccggttgcaagggacgtaaccgactgtgcgacggttcttgagaccatcgcatctcatgatgtaaaagacagcacttcggtagaacgccaggacacggattttacgagtgcgttggtaaacgatgtaaaagggatgaagatcggtattccaaaagattattttggagaaggtctggacgaagaagtgaaaaaaccgattctggaagccgcagaggttctgaaaaatgcaggagctgagattgaagaatttgatcttggacttgtaaaatatgcgattccggcttattatgtcatcgcatcagcagaggcaagttccaacctgtcccgatttgacggtgtgaaatacggataccgcacaaaggattatgaagagcttcaccagatgtacaaaaagacccgctccgagggcttcggaccggaagtaaagcgccgtatcatgctggggtctttcgtactcagttccggatattatgatgcttattatctgaaagcactccgtacaaaagcactgattaaaaaggcatttgacagtgcatttgcaaaatatgatatgatcctggcgccggcagcaccgacgacagcaccgaagcttggagcttccttaagtgatccgatcaaaatgtatctgggcgacatttatacgatttccgtcaacctggcaggacttccggggatcagtattccggttggacaggatgcgaaaggacttccggttggaatgcagctcatcggagactgcttccaggagaagaagctttttcaggcagcttatacctatgagtgcctgacagagaaaaaatgggtatctatgtacgacaaaacagaagcagccggaaaggaggaagcatagatgtcaaagcagtatgaaaccgtaatcggtctggaggttcacgtagaacttgcaacaaagacaaaaattttctgtggatgcagtactgcattcgggggcgcaccgaatacacatacctgcccggtatgtaccggtatgccgggctcccttccggtattaaataaaaaagtagtagaatatgcgatggcagtaggacttgcgacaaattgtaagatcacacaggtgtgcaaattcgatcgtaagaattatttctatccggataacccgcagaactatcagatttcacagctctatctgccaattgcgagagacggctatgtagagattgaagtcggagagcagaagaaaaaagtccggatccatgagatgcatatggaagaggatgccggaaagctgatccatgatgagtgggaggactgctctttagtagattataaccgaagtggggttccgctgatcgagattgtatcggagccggatatgcgttcggcagatgaagtcattgcttatctggaaaaattgcgtatgatctgccagtatctgggagcatcggactgtaagcttcaggaaggatccatgcgagcagacgtcaatctttcggttcgtgaagtaggtgcttctgagtttggaacacgtactgagatgaagaacctgaactcctttaaagcgattacacatgcgatcgaaggagagagacagagacagatcgaactcatcgaagaaggaaagaaagtcattcaggaaaccagaagatgggatgataataaagaatattcttatgcaatgcgttccaaagaggatgcgcaggactatcgctatttcccggaaccagatctggtgccgatcgtgatcagtgatgaatggatccagaaaatcaaagaccaacagccggagctgagaagtgaaaaacttgcacgttatgagaaagattatgatattccacgttatgatgcggagctcattaccggaacgaagaagatggcagatctctttgaggagacctgtgcaatctgcagcaagccgaaaaaagtgtccaactggctgatggtagaaaccatgcgtctgttaaatgaaaacggacaggagccggcagatattaaattttcaccggagaaccttgcaaaactgatcgaacttgcagacgcgggaactatcaacagttctgtagcaaaagaggtatttgaaaaggtatttgcagaggatgtggatccggaaaaatatgtagaggatcacggactgaagaccgtcaacgatgaaggtgcactccgcacacttgcggaagaagtgattgcaaagaatccaaaggcagtggaagatttcaagggtggaaaagaaaaagcacttggcgcactggttggacagatcatgaaggcaatgaaaggaaaagcaaatccgggtatggttaatgaactgctcagagagatgctgaaataaaaatcagactgacagaaatcctttgcggaataaataaaaaaaacgagtaaatgtcatgtgaaaagacatttgcccgttttttattacatatactgtatctgctctttcgccggttccgatgccggattttcaaagaatttctctttttccgtcacttccagtacttctccctgatccatgaagatcacctgatcggcaattcgctttgcctgagccagattatgtgtgacgatgacgaaagtatactggtctttcaactccaaaagcgtttcttcgattgcaattgtattcttcatatccagtgcggagcacggctcgtcaaggagcaggatctccggaccggcacagaggcttcgtgcgatagcaagacgctgcttctgaccgccggataatttgagggcggatttttttagttgatctttgacctcatcgtagagttttgctttctgcagagactctgtaattttctcagcaatctctttcttattacggacaccgtggtatttcagtacataagacagattcttttcgatactgtgagggaaagcgatcggctgttggaaaaccatgccgacacgccttctgagtttttctttcggaagagatttgatgtcggttccttctaaagtaattgttcctgagagatagccgccttcttcttctaccatccggttcagggtttttagaaaagttgtttttccgcagccggactgaccaacgatggctgtaatctgtccttttgggatcgtcaggctgattccgtgaagaatttcgtgttttccaaatccacattttagattttctatattcagcatatcagttgtcctttcgtagataggtgataaatttacatattaactggatgatgagtaggaagagcatcagtacaaatgcggttccataagcataatccagagaaaatccgttgttcacaaggatatacaggtgatatggaagtgacatgaacggatcggagagagaatgcggaacatctgcctgcatgacagctccggtgtataaaatcggtgcaacggcacccatgccgtatgccattccaagcgcaacggttccgagaagctctacaaagcagaccggaaggatcagtttccggagggcatactcacgggaaagtccgagacttagggagttcttcatatattcacgccccttctcttccagaatcttttctgctcggattgcaacaaaaggaatgatcattgctgcaacacacagtgccgaacacagaaggctgcggttaagtccaaaacggtagatcagaagcgtatatccaaccagcccgaacaggatcgaagggattccggaaagtccggtgatcgccatatttacaaagacggaaaatcgttttccggtgctgtaaaatacaagataaatggcagcgccgataccaagaacaccgccgatcagtgcggaaagtgcgccaaggtaaatggaacccatcaatgccggatagataccgcctgcagttccaagtggaacaccggcaggcttgtccagaaggaaggacaggctaaatacttttttccctttccagaagacataaaggaaaaggaagagtgtaacaacgatcacgcaaagcccgagtatactgagaatcaggcgtgtgaaaaatttctgcagtttagttctcatgggtggcaagcctccttttcagaagatagctgataccgagtacgatgaaaagaatcacaagcagcacagcatttgcaacgtaaagtacggagaggtgaaggcttccgtattcaatacttcccatttccagtgcggtgagggcaggaagtgtctgaccacgtccaaggagtttgggataaatcggggaattaccgattaccatcatgactgccattgtctcgccaagcgcgcggccgaatgccatcattgcacctgcaatgattcccggccggattgccggaagaatgaaatgcagcagggtaaattctctggagaatccaagggtgatcgcactgaactcgtaagtctttcgtgcagtctgtaaagattcatgacaggtggaaataacgaatggtaaaagcatgatccccagcacgatcccggctgccaggatacattgaccggctgccatatggaggtgggtggcaaaggcttttacaagaaccgtaagtccgataaatccgaagatgacggacgggattcctgcaaccagatcgatgaacgcaaggaatatggatgccacctttttcggaaggtaatagtccagaaagcaggcacaggcaacgccgaagatgagtgcgaggacaactgcgatcgctgagacataaagggtaccggcaatcgcaggtaaaagtccgtactgcggtttctgactgacagggcgccattcagtggtaggcaggaacattttgattccaagctgtgaaatggcaggaatactttccttcacaatgtggatcatcatgactgccatcagtgccgttacgagaaaggcagccagataaatgattcctttgctgaatttatctgaaagtttcttaaacatagtaaatcctttctaggtatgatgcaggacagacagcgctgtccggatacaaatcaaaattgacccctgggattaaccagcgacatatagcaagaaaaaggggtgtgtctttgcacaccccttcaatatcggaagattatttcataggaatgaatcccatatcttctacagttttctgtccttcatcaccaagaacgtaatcaaggaaagcctgctgtacatctgtcggatcaccagaacctacaagaagaagtggtctctggatgatgtaagatccatcaagaatgttttcttttgttgcagcaacaccgtttactttcagtggagttacttttccttcattctggttagcaacaccaaatgaagcatatccgattgcgtactggttatcaatgatatcctgaacaagttcacccatagaagaagcctggatcgcatccgcttttacttctgtgtcacccatgatattcttctggaatacttcgtgagctccaccgttgatatcacgtgtaataacaacaacttcttcgtcaggaagagatgagtcaagatctttccatgtagcatattcgccggagaaaagtcctacgatctgttccgttgtaaggttatcaagaacatcatttaccggattagccgggtttactgcgatcgtcagagcatcgataccaacctggtattctttttcatctttgattgcttctttttcttcatcctttacgcttcttgcaaccataccaaatgttgcagttccatcgataacggctttggttccctgtccggatccgcctgctgaaacgtagattgcgatatcttcttttggaagagatgaatcatatgcatcccatgttccataagtatcaaagaaagtagtagccatagaagtgataaccggtgctaaagtagaagatccgttaaataagatctggttactttctgtatcggcagaagcttctgtctttgcaccctcttcttttttgctgtcagcagaatctgacttgctgcttccgcatcctactgccatagatgataccatagcaagtgtaagagcgattgataaaaatctctttttcattgtatgtattcctccctgaataaaatttacatatccgaaataagaatttaacattcttttaataaaatgtatgttgcatggacaacattttccatagataatccgcatgattgatatagaatatatctatacagtaaatatctatggaaggaatgggaaagccatgctatactgtacatacgaatatgtgtttggtttttattctacgggaacttcctgtgaaataaaaggtattgcgtgccataggtgcacattttttaaattatggaggaattcatgacggaagaaattaaaaagctgatcatttatacaagaaaaatgaagaaaagggagccgttgtaccgggactacccggaggagttccgggaagaaatccggggatatctggaaagcaaccatatttccagactctatgcacatcaggttgagatgtttgagaaggtcagagccggagaaaatgtggttattacgacttcgacggcaagtggaaagacgcttgcctttctgctcccggtattgcaggaaattctggaagacccgctgacacgtgcgatttttatttacccgaccaaggcactggcaagtgaccagtaccgcgcgatgcagtcgattttgaaatttttcggagagggaagagtttcagcaggcgtgtacgatggagataccaaacctgccgagcggacaagaatacgcaagagcgcaaatattatcctgaccaatccggagatgctgaactcggcattccttccgaatcacagcaattacgggtttgacgcgatttttgcaaatttacgatatgtagtgatcgatgagcttcattcttaccgcggtgctttcggagcacatctggcaaatattttccggagaatgcaccggatttgccggtattaccattcgaatccgcattttctgtgcagttccgcgacgatcgccaatccgctagagcttgccgaaaagatctgtggaagcggatttacgctgattgaccgggatggatcgccggcaccggagaaggaatactgtattatccagccgccggagatcaaggggaataatgacaaagtatacggaaggattgcggcgtcaaccgtggcagcaggactgataccggagttggtggaagaggatcatcattttatcacctttggacgatccagaagaaatgtagaagttattctaaaagaagcaaaggataaattagatgctgccggatttcttggaatggcgcgggtgggcggcaagaatccggcagatctgatcgcaggataccgtggcggttataccccgctggagcgaaaagagattgagcggaagatgacggagggagaactgaccgggctggtatcgacgaatgcactggagcttgggatcgacatcggaaagctggatgcaactgtgattgtcggttatccggggacaagggcgtccttctggcaacagagtggacgtgccggacgaagcggcagtgcctgtgtcaattatctgatcctggaaaatgaaccgtttgaccagtacattgccatcgatccggaatggctgttctcaagagaaagtgaaaatgcgatcgtggatccggacaatcttctgatcgagcttgcacatctgcgcgcagcggctgctgagatgccactttcactggatgatattgcgctttttccggatcttggagaaatgatcccggtgcttttaagcgccggagaagtaaaaagccttgccggaagatttgcctgggcgggacctgcatttccggcaggggattacagcctgcgtaatatggacaagaccaggttcaagctgcttgcgcaggaggacggacatgagatcacggagatggacgaatcccaggcataccatgagatccatccgggtgctgtatatatgcatgatggtgcatcctatgagatcacgaagatggatctggtcagccggacagcttacgccattccgtttacaggggattattatacggtaccggcaggacaggaagagacgcgtatcctgcatgtatttcaggaggacacttaccagaggacggaaatccgttttggagatatcaatgtaaacgaaatcattgtcatgtacaagaaactgcagttccataaccatcagaatctgggctatgtgacgctgacacagccgcttcagaaggattatggcacggaaagcacctggcttacaatgccggagaatgttgtcagagtctaccggagtcttcttttgccaaatcggatgggagagctggtgctgaacaatcattttgacggaatgcagtatgcgatcaagaatgcagtaatgatggtgacgatgacggaacgggatgatatcgatgtgaccatgtccaacaatgcgaccattccggatgagttccgggaggaaaaggtgtccctcttcatttatgacaaatatgagggcggacttggttattcggagaagatctatgatctgattccggaaattctggaaagtgcgattaaaatggtcagtggctgtccgtgtgaggatggctgtccggcatgcgtaggtgactacaatctggataagaagacggttctgtggggacttgataatcttctggaagagagcgaaccgccggtttatctgaagaaaaatatcaaagagccacagcctgtgatccggaaagaattttctttctttaatctgccggatgagtgggagaaggtctgttatgccgtggtcaaaaatggcgaggcaggcgggcagtttctgaagaccattaaaaaagtcagtacagaaggacacaagctgatcctgacgatggaaaatgaattttatgcaaaatggctgatggagccggataacctccaaagtctgaccaataccttacggtatcatgtgatttgtccggcggatatgcagatccgggtacggtatgaagcgaaaatggatgagcaggagaaaaaagaacgacagaagaagagagaccgtttgcaaaggcgatatgatgaacagcttggaaatgaataatatagaagaaataaaaactttaaatccttaccagcaggaggcggtgctggatgaaagcccggcatgtctggtaaatgcaaatgtagggagcggaaagacaacagtgctgatcgagaaagtgcggcatctgcatgagaaaaagcaggtttcgtatgagaaaatggcagtgcttacctttaccaacaaggcggcagatgagatcgcagaacgtctatccagaaaagaagcagagcttacggaagaagaactgtggggatttggaacctttcacagtgttgccttaaggattctgcgaagatttcttccggaaaaggcagaagacggaacaaaattggaagaatggaaccgggaatttaccgttatcacaccggaagatgaaatggaaatggtgcttgccatcgcaaaagaaggcggttataagatcaaataccagaaccgtttgaaaaagcggatggaagaggattacgcggcatatcggaaaggaagaacacagggaaaatacaaagatgatctgtttcagatttttccgcttcttgagaaggcaaaaagacagcagaataaaatgtcctttgcagatcttctggaagaaggaacgcaggtggcaaaagagcaggaagcggtgctggatcttaagtggatcattgtcgatgaggtacaggacagtgacgaaaaacagctgaaatttctggaggcgttaaaaggcacacagacccacttttttgcggtgggggatccgaatcaggtgatctacagctggagaggaaccggaccgaatatgttcttcctgatcaagcacagatttggcgcaaaagaactgactctgccggttaactaccggtccgatgaagtgatcctggaagcggcgaaccggtttcttcagtttggaggaaagattgagggaagtggcgaaagaggggagaagattctggtaaggaatcattatgatccatttatcgaggcagagtatctgacagagcggatccgtgagcttcatgagcagggacttccttaccgggagattgcggttttctaccgggtgcagaagcaggcagagattctggaaaaagtatttgaaagagcagaacttccttatgttcttccggcaaaacagaaagaggatgaggatccggttccggaaagacctcatatgatccgggagtatgttgcagaagggaagctgaatgcggtttcaggcgaacatacgatggaaaaagcggcagatacagaacgacagacggaggaagaagacgcagttcatcttatgacactgcacgcctcaaaaggtctggaatttgactatgtattcatcatcggaatgaatcaaggactgatcccgtttcgctgcaaaagcatagaacaggaagaagaggagcgccgtctgttcttcgtaggactgacccgtgcaaggaagaatctggaactttcctattatacaaatccgacgatcccggggacatatgagacaccaagcaattatctgcggatgctgccggaggagctgcttgactgggaagaaaagccgggaagtgagtcgcggaaagcgaatctgcagaaactgcggaaagatacgcgggagctgatcagggagaaaaagcaggaggaagaagaacagaaagaaacacggaagccagagcgaaaaggcagacatccgaagtacggggaagggaagattatttctgaggacgaaatgatgatcgaactggaatttccgggatatgggaaaaaacaatttctgaaagcatttggcgaagtggaagttttgaaaggcttatagaaaatggcaatacaaattgtttactgaaagaatttatcaataaaatattttttcatgaaagggcatatgggagtgaatttttttcacctctatatgccttttaaaagaaaagtgaatatttattcatagaattatcgcgataattttattataatttcaataaattttatgaatattttatttatttctaaggaggtagcaatatggatgctatgaaaatcgccaacagtataccgatgtggatcgcctgtggaatcccggtaatactcgttatcgcacaggccctgatctttgcaaaaaaatcttattcggcaggaaagaagatcggacttacagaaaagcagatgaagaacgcaatcaagagcagcgcgatcacttccattggaccatctattgtaatcttacagtgtactcctgaaagatgaaaaaaatatcgagcttttactgcgctttttgaatctggaagaaaaaatttaacgtttccttgaacaagaattgatgattttcagggcaaaagatgatacaatatatattgtgtgaaaaaaaagacaaaaagggagatgcctatgccaaagaaacagaaggcaaagataaagcagaaaaataaatgccctgaaaagctgatccggacagaggctgcaaaagagattgcagagatagaccgttcgcttcaggatcagaagtatcagctcagatgcagagctgcaatcgatcttcttacagcaaagctgaatatgataaatgcagatctttcgcgcaagaaacgccatgttgtgatcaaccagatcagcagcagagtgaagacggcagagagtatttatacaaaactgatccggaaaggcctggagccggattttgacacggcaagagcagaactgaaggatttgatcggaatccgcgtggtctgtccatttgaagatgaagtgtacgaggtcgcagaccgtctgaaagcgcagggagatgtacagatcatccgtgagaaagattatattaagaatcccaaaaagaacggatacaagagtcttcacatgatcgtggaggtcccaatttattcatccaaaggaccactgaaggaaaaggtggagatccaactccgtacggtggcaatggattactggtctgtgctcgagtaccagatattttataagaagacagagaatgaagaggttgcaaaggaattaaaaacctatgcagatgaaatttctgagctggatgcaaaaatgctgaaactcagggataagattgaaaaaatgtagtagaaacacagggaaagaatgtgcgaaggcgcattctttttttgatacaatcaggaaatcaattgcataggcattccagttaggttataatctagtacagtatggacagataaattacagaatggatatgaggaaataccatgaaaatgatcaagacagataaacttgtatttgaatatgaaaagcgtgacgaagaaggtaatattatagggaaaagccgcgctattgatgaggtatcgctggatatcgagccgggacagtttattgcgatcctggggcataatggctctgggaagtctacacttgcaaagcatatgaatgccctgctggttccgtctgacggaaccatgtgggtagacggaatggacacgaaggaagatgaacatctgtgggatgtacgtcagagcgccggaatggtattccagaatccggataatcagatcataggaacggtcgttgaggaagacgtgggatttggtccggagaacctgggcgtgccgacagaggagatctggcagagagtggaagatagcctgaaagcggttgggatgattgaataccgtcaccattcaccgaataaattgtccggggggcaaaagcagagggttgcaatcgccggtgtcatggcaatgcgtccaaagtgtattgtactggatgagccaactgcgatgctggatccgaatggaagaaaagaagtacttcgaagtgtgatggagctgagaaaaagagaacacattacagtgattctgatcacccattatatggaagaggttgtagatgcagaccacgtattcgtaatggatcacggtcatgtggtaatgcagggaacaccgagagaaatcttttcacaggtggatactttaaagcactacagactggatgtgccgcaggtgacgatccttgctgatgaactgagaaaaagaggacttgatattccggcgggagttttgaagaaggaagaattggtggagatattatgtcgattaaattagaacatatcaattatgtatacagtgaaggaactgcatatgaaaagcatgcgctgaaggatgtatccctggaaatcccacacggtgaatttgtcgggatcattggtcacaccggctccggtaaatcgacactgatccagcacctgaacggactgatcaaggcgacaagcggagcactttattacaacggagagaatatttacggagaaaactataacttacgtgagctgcgaaatcaggtcgggctggtctttcagtatccggagcatcagctttttgaggtcaatgtacttcaggatgtctgttttggaccgaagaatcagggactttcaccggaagaatgtgaaaagcgggcaagagaggcgttgcagcttgttggtctcaaagaaaaatatttcgatcattccccgtttgatctgtcaggcgggcagaaaagacgtgcagcgatcgcaggtgtactggcaatgcgtccgaaggtactggttctggatgaaccgactgcaggactggatccgaagggaagagatgagatcttggatcagattgcctatctgcacgaaaaagcagacatgactgtcattttagtttcccacagtatggaagatattgcaaaatatgtggatcgtattattgtgatgaataaaggcagcgtcatgtttaatgatgtgccaaagaaagtgtttgcacactacaaagaactggagagtgtgggacttgcggcaccacaggtaacgtacatcatgcatgcgctgaaggaaaagggaatggatgttccgacagatgcaaccacgatagaagaagcagcggatggcattatgaaagcactgaagaaggagagggcagccaaatgattcgagacataacgattggacaatattatccggctgacagccgtatccataagctggatccgcgtgtgaagattgtatgcacactgctgtatctgatttctctttttacatttaaaagtattttgggatatgtacttgcgactgtgttcctgtttggatgcattaagctggcgaaggtaccgtttaaattcattgtcagaggactgaagccaattatcattctgcttctgatcacagtatgtttcaacttatttctgacaccgggcggaaagacactggttcatgtgggctttatcaagatcacggagtacggcttaagcacagcggtttatatggcgatccgactgatctatctgattatgggatcctcacttatgacactgacaactacaccgaattcactgacagatggtctggagaagcttcttcacccattgaataagctccatgtaccggtacatgagatttcgatgatgatgtcgatcgcacttcgttttattccgatccttctggaggaaacggataagatcatgaaggcacagattgccagaggtgcggatatggaaagtggaaatctgatccagaaggcaaaggcaatgattccgatcctggttccgctctttgtatccgcatttcgccgtgccaatgatcttgcaatggcaatggaagcaagatgttatcgcggtggtaatggcagaaccaagatgaaacctctgatttataagagtgctgaccacatggcatacctgattacgatcctgtatgttgtgatcgcatttgttgttggaagatatgttccattcaagctgtggatcttttaaggagtcataagatgagaagaatcagattaacagtggcttatgatggaacaaattattgtggctggcagatccagccaaatggaattacgatcgaggaagtgctgaataaggcaatctgtaagctcaccggagaagagattcaggtgataggggcgagccggacggattccggggttcatgcaagaggaaatattgctgtgtttgacacggaaagcaggataccggcagaacgtttttcttatgccctgaatcagcgtcttccgaaagatattgtagttgtaaaatcagatgaggtggatcttaactggcatccacgttatcaggatactctgaaaacctatgaatatcatatcatcaatacgaaagtgccgattccgacagagaggctttataattactttgtaagttttgacctggacgtggggcagatgagacgtggagcggcttatctggaaggagaacacgattttgcaccattttgctgtattcgtactaatgcaaagacaacggtgcggacaatcacggatttgcagattctgcaaagcggagagcatattacgatccggatcacgggaaatggatttttgtataacatggtgcgcatcatagccggggtactggtgcgtgtcggaagaggattttacgaaccggaaaaggtaaaggaacttttggaaggcggagaaagaaccagggaagcggtcacggcaccgccgcagggactctgcctgatggaaatccgctatcagaatgaagaatagtgcatgagtctgctttttaggcaggctcatttttttaacaggaaattctgaatagaaggtactacatatcggagaaattttacaatagaaaaactctatagagaagtcggtctatccggataaacaataagtaaaacaggcagttttattgaagaaatattatgaaaatgttatcctaataaccagaggcattttggaaaaacagcatagaaacaggatgtcattaaagagagaaaagggaagaaatatgaattatgtaggaattgatatcggatcaacagcatccaaggttgttgttgaaggagataagaaagaacatttcgtactgccgacaggatggagcagcaaagagacttgcgaaaagatcaagaataagctgcttgagatgggggtagatgttacctcagatgatacaaaggtagttgctacaggatatggaagaatcgcagttgattttgcagatcatgtaattacagagattacctgccatgccagaggtggtcgtgaacttgcagggggagactgttcgatcattgatgtgggaggacaggatacgaaggtgatcattgtacagaatggaatggtatccgatttccagatgaatgataaatgttcggcgggaacaggaaagtttctggagatcatggcgaaccgcctgggtgttacgatcaatgaattatttgatatggcggcagcaggagaagttattccgatcagctcactttgtacggtatttgccgaatctgaggtgattaactatatcggagaaggaaaaaagcgtgaagatattgcggccggagttgtagattctgttgccaataaagtagtgcagcttgcgcagaaaaaggaacttggagacagagtgatcctgaccggaggactcagtcacagcatttatttcacaggaatcctgtcagacaagctggatcagaaagtggaatcagaagagtttggccgttttgcgggggcatacggggcagcacttcttgccagagaaaaaaaggataaaaggagataatgaaaatggaactgattaaagatttaccagaggtatttgaggaatttgcagagcagagacagaaatcgtttctggctgtcaaggagttaaaagagaaaggggttccggttgttggatcgtactgtacatacttcccgaaagagattgcaatggcgatgggggcaggatgcgtaagcctttgctcaacttctgatgagacaattccggaagcagagaaagatcttccgaagaacctctgtccgctgatcaaatcaagctatggatttgcaaagacagacaaatgtccgttcttctatttctcagatgtagtagttggggaaacaacctgtgatggtaagaagaagatgtatgaatatatgtcagaattcaaagatgtatttattatggaacttccgaatagccagagagaaccgggacttcaactctggaaaggcgagatcatccgtttcaaggaatatctcgaacagaaatttggcgtgacgatcacggaagagcagatccgtgaagctgtaaagacagagaatcaggcacgtcgatccttaaagaaactttatgaagtaatgaaatatgatccggctccgatcaaaggacaggatctgttcaaagttctgtacggaagcaccttcaaatttgaccgttccctgatcccgggtgaagtggatgctcttactgcgaagattgaaaaagaatatgcagagggcaaaagagaagagaagaaaccacgtatcctgatcacaggatgtccaatcggaggagcaactgaaaaagtaatccgtgccgtagaagacaacggtggtattgttgtaacttttgaaaattgcagcggtgcaaaatccattgacaagctggtagacgaggacgcagaagatatctacgatgcaatcgcaagaagatacctcagcattggatgctctgttatgacgccgaacccgaatcgtctggagcttcttggaagactgattgacgaatatcaggtagacggtgtggtagatatgatccttcaggcctgtcatacctacaatgtggagactaataccatccgcaagtttgtgacaggtgaaaagggaattccgtatatcagtgtggaaaccgattactctcaggcagacatcggacagctgaacaccagacttgctgcgtttgttgagatgctgtaaatggagagtatgacgaagagaaatgcgtttcagttccgcagggcgaatgaggaggatcttcctgaaatttgtcgtatagtaaagcttgccggagaaagtgttcccgtgaaagaatggtttgaggcagaggatgaagaatttcttgcaaagcatatccgtgaggaaggatttacccttttggcaaagaaaaatggacagattgcagcaatcatgattgtccgtattcccggactggcagaggacaacctgggagaatatctgaagatttccagggaagaaatgaagcggattgcgcatctggagattgctgttgtagtaccggagtatcagggatacggactgcaatatgagcttttctgtcagtcagaagcaatcgtaaaaaataagcagatgaggtatctgatggcaacagttcatccggataatatatacagttttcgcaatatggaaaagcttggaatgaaggcagttctcgagacaaagaagtatggcgggaaacgaagatatgttatgagtaaaacattagaatcttagaaagaaacgaaagagcttatggaaaatgtaatggcacattttccataagctctttttgaatacaagtatgaattgtaaaatgagaaagtttcttaactaacaacttcaatgttaacatactaacttcgggtaatataaactattctaagttagaaaatgcaaacaagaggaaacagaatgaaattcaaaaataaaatcattgtggtctgtctgtgcgcatctgtattcgcgggtggatgcggtcaaggtggtcagaatacaacaaagagtaaaaatagtgaaggaacagccagttcgaaggaaagtacagaacgaatctctcaggataatgaggcatcaaaagacatttttgcaatggatacctatatgacagtgacagcatatggagaaaaagcacaggatgcggtggatgccgctgaagcagagattgaaagattagatacacttttatcaacgggaaatgcagacagtgagattgtaaaactgaatgaacagaaaagtgcaacactttcagaagatggcggatatcttgtgaagcgcgcactggaactgaataaggaaacggatggggcatttgatatcgcaatttatccggttatggaggcgtggggatttccgacacagaatttccgtgtaccgtcggctgatgaactggcaggacttctggaacatgtggatgcatcgaagatttcatacgataaggatacaagaaaaatctcatttgaagatgaccagatgaagattgatcttggggggattgcaaaaggctacacctcttcgagaattatggagattttcaaagagaacgggattgaaagtggtctggtaaatctgggcggaaacgtacaggcactcggaaccaaaacagatggaagcaactggagagttgcagtgcagagcccagacgataccgaggactacctgggagttttatctattcaggataaagcggtaatcacatccggcggatatgagcgctattttgaacaggatggtgtaacctatcatcacattatcgatccaaagacaggatatccggcagagaacggactggtatctgtcacgatcgtaagttcggatggaacacttgcagacggactttccacatccctttttattatgggtgagaaaaaagcggcggagttctggagagcgcacagtgaggagtttgaggcgatctttgcgacagatgatgggacgatttatgtgacagaaggtctgaaagacagctttacaacggatcttgacatgaaggttattacgaaataatttgcgtgaaatgagaggataatgagagatggacatcaaagaaaccggtaaaaaattaaaaccgtttgcacccgttctttcagttgcactggttacggcgtgcgtggcaggctctttaagtggatatgaggctccggtctatgcggtgacacaggaagaaacaccggcaaaaaaagaagagacaaaagagaagaaagaagaaaaaaagacagcagccaaaggatcatttgacctggaggatggtgtgtataagggaaccggaaccgggtatgcaggagacatcaccgtatcggtactgatcaaggacaagcagatcgtttcgattgatattctgagctcttccgatgatgcggcgtttttcacgcgtgcgaaagcggtgatcgacaagatcatcgaaggacagacgctggatgtggatactgtatcgggagcaacgttcagttccagaggaatcatcagcgcggtaaaaaatgcgctgaccggggaaaaggataccagtgagacaggacaggcgcagtccggtcagacaggggcagcggcaggaagctcaactagtgtggcacaggtagaagatgcggcagcgtataaggacggaacttattacggttcgggaaccggatttggcggtccgctgaaggttatggtagaaatcagcggagggaagatcgcatccatccagattgtggagaacagtgacggaagcgattatatttccaaagcagcttctctgatcgattcgattattgcgacacagagcaccaatgtggatacggtgtcaggagcaacctacagttcagtcggaattatccaggcagtccgggatgcactgagtcaggctgcggtaaatggtacatcagatacttcgcagaataacaataacaacagtaataacaatagttcatcagacgacaataattctaccgtaaccggaaccgttccgtacaaggaagggatctattacggaacagcagatggttacagcggagatgtatccgttgcagtcgtgatccaggaaaagacgatcaaagcgatcctgatcacagaaagctcggatgatgaagcattctttaatcgtgcaatggatgttgtgaaaaaggtgataaggacacagaagacagacgatgtagatactgtgtcaggagcaacctacagttccaaaggactgttaaatgcaatcaagaatgcactgaaacaggcagagaaagtgacaaatggagaatccattgatgagaagccggatctgactgatctgaaagagctgatcgagagagcagaaaagttggaagaagataaatacacagaaacaagctgggcagttctgcagaccagacttgcggacgcacaagaagcacttgaggaaacaaaacagactattgtggataaagcagtagaaaagctgaaaacagcaattgctcagctggaatcaaaagatggaaaagacgaggaaaatacaaaatatgtcagtggaacttatgaagtgaccgttccgtgtacgccggatgatgacgaagattttgaagaatataatctgacgatgacggtgacgatccgcgacgacaagattgtggcaatcacggatatcacgggcgatggggacagcagtaatgacagatatatcacgaaagctgcaaatggtacttcaagtataaagggtgtggtatcccagatcatagataaaggaatgccggaggatattgatactgtttcccgtgcaacctgctcttccaatgcaatcctggaaggatgcaagaaagtactggaagaagcagaaagaccgacagatatggaggctgaataacaatgagagaattctgggtaagactggtaagtatgctcgcgatcgtgggagttctgctgggatacaattcagtgctggatgtgcgtgcgaaagaagatgagatcgcctggctttccgtacaggttgccggaaacggacaatcagacagcggaaatggaggttccacaaactacaaggacggaacctataccggggaagctgatggatttggcggaacgatccaggtagaagtgaagattgagaaaagcaagattgcagagatcaatgtgatatcggcagagaaagaagacggagcatacctttccatggcaaaggatattattcccaaaatcatcgatgcacagagcgcagatatagatacgatcagtggtgcgacattcagctcgaccggaatcaaaaatgcatcggaacaggctctggaaaaggcggtaaagtaacgtgaaaaagatggatattcataatttaacggcgaaagatataaaaaaattacatatatggctgagagcattgatccaggtactttattttctgtttatcccatctgtgtatacagcggcatttgccggagtgaaatacatctttacacagatcggtgcaggcgaaaaggttgccgtgacctctttcgtgacagtactggttgtgatctgcatttacaccattctgttcggaagattcttttgcggattcgcttgtgcgttcggtacactgggagatggtgtgcatgcactctatgtgtggatttgtaaaaagatgaaaaagaaacctcttcagattgcggatgcatggacagaaaagctctgttatctgaaatatattgtactggcactgatttcaatcctgtgctttacaggcgtctacagcaaagcaaaaggaaccagcccgtgggatgtattttccatgctccatgcaggcaactttaagcttggcggatatctggtgggactcgttcttctggttctgatcctcgtgggaatgtgttttgaagaacggtttttctgcagaaatttctgcccgatgggagctgtgttttccctgcttccggtccttccgtttttcgcacttcacagagaccgggaaaactgcatcaaaggatgtaaggcatgtacaaagaaatgtccttctaacattggacttccggaagatggatctccgaaggtagaaggggactgtttccagtgtcagaaatgtatcgatacctgtccgaaaggaaatattcataccggagtaaaaggactttgtggaaatgaattctggtttacgattttgcgggcagtaatcttactgattcttctactctggctgggtgtatagaagatgaagaagaaagatctgatacttggagcaggaattattgtgattgcgcttgcgatgctgcttgtgatgcagctgacgagaggggaagaaggaaatcagatccgggttatgctggatgggaaaatctatggaacgtattccttgtcgaaggatcagaccatcgaagtaaaggatggcgatttttataaccggatccggatcgaagacggaaaggcgtatatggaagaggcaaactgcccggatggatactgtgaagagcagggaaagatcagcgggcatacacagacgatcgtctgtctgccacataagctcgtagtagaggttctggaaaatgagaatgaccagagctttggaacttcagatccggaagatgtagctccggatacgatcgcaaaatgataaaggaaaaacagatgaataaaaacaaaaaacttgccaatatggcaatgctggttgcgctggcgatgatattcagttatgtggaaagcttaataccgatcaatttcgggataccgggaatgaagctcggagttgccaatctggtgacagtgactgggatgtactttctggaatttccggaagtatttctggtggtagttatgcgaatcctgctgaccggctttttatttggaaatggaatgtcgatcgtttacagcctggcaggaggaatcttaagctttctggtcatggcgctgatgaagaggctgaaaggattttccgtagccggagtcagtatcgccggaggcgtgtcacacaatatcggtcagatcattgtggcatcagttgtggtagagaatctgaaactgatttattatcttccggcacttctgatcgctggtacagtgaccggatttgtgatgggaatgataagtaaaaagttgcttccgatcgtaaaaagagaatcggagagagaggcgcagataggttaattttttttaattatgggttagcagaaactaacttaataataaattttatcaacaacaaggaggtaattatgggaaagggaacaattaagacaaaagctatgacgatggctgtggcgatgtcaatggtagctggactttgtccgtcgacggtgtttgcggcatcgggaagtgaagttgcggcagatgggacttatacgaatacggctcatgtaaaaagaacagatgctgatactgacgatgaatggaatgagtatgatgttaaggtaagccttactgtaaaagatggaaaattttcaaatattacggtaacaccaggagaaggatatgattctggaaatgacaattactttaataaagcttataataaatcaaaaggaatcaagacgctgcttgaaggaaaagatgcgacagaagatgtagtgaatagttggaaaacaaatagtgcagaaggtacagatgcagtaagtggtgctacatgtacagcaactgcaattaaagcagctgcacttgaggcaattcagtctgcaccggtagcttcaactgtaacggtagatacatctgctcttgaagctgcaatttcaaaagcagaaggattaagtaaggatgcatacacagaagcaagctggacagcaatgcaggaaaagctgacagcagcaaaagaagctcttacagcaaaagaatcccaggaagcagtaaatacagcagcagatactttaacaaaagcaattgatgcacttgtgcagaaaacaccagatgcacagaaagaagtctatgtattaatgaacattccatatgctgatttctacaaagcagatggagtgacaggtgcggatactgtttcatcagcaacaaaacagaagaccagagcttcactggcagccggatcttatcatgtaaatagtgatggttctgatattaccggtgtaacattcccggttaagatcagtgacgtttctgcattagaaaaatatacccagattaaagatgacagtaaagttgatattacaacatccattaaaggaaaagaatcaacaactacatacacaggaaaagaagcgttgtttgagagtacaagttactcctattatattttgagtgatgttccatcttattataaagaagcgactgtaaatgcagacggaagttttagtttcggcgaagtaaaaggggcaaaaacacagagactttcagatgtcagcacagagttttcaacatcatcccgctacggtgattatcagttggatatcgacggccttccgtcagaaattaaaacagtttatggagttgtaatcagcacaaaagaaggaagcagttacggacttcgccatgtggaaaatatctggaagaaaacagaacttgcatggagtacaggatttgtaacagaatcccatgggaacacactggatttcaaagattatgctgccatgatgggacagacgatcaataaagtaacttactacacagatcagggtatttatgaaatcccgatggatcagaaagttgcaaagaaatttgacggagaagtatcagtagaagatgtatctgtgaaatcagaaaaaacagctataacggtaagtggacttccaaatgattttgaagaagagtataaaattgatggaatcgatgaagatgcatattctgttgaggttaaatcagatggcaagacaactacaagaacaattaattttaagaaagcacttacaaagaggagatatacagtaacactcagtgataggagcggaaattatgcaccaatctccacaacatttaatgcttatacagaaacgatgccggcaaaatataatgaaaatgacaaagatccggctgtggtgaaagcggatggtgttgatgaagaagaattccagacatatttaaaaaatattacatcagtaactgtgaatggaaaagaatatgcagcttccggaaaaaaagcagtaaaactaattacggaagacggaaaactggatctttcacaggatgcatttaaagatgcaaaagcaggagaagcatttgctgtaacaatcgcagaagacggttatcaggcatatacatttacttataaagtaccggaagaagacagtgagtattcttatgtcctcatgaatattccatacgctgcattctacaaagctgaaacaacaggtaatgatactaaggtagatgcatttacttctgcgacaatgaacaagaccagaaccaaaggccttgcaggtggatcataccatgaaaatgcagatggatccaagattgatggtatcacttatgctgtaaaagtagacccttcggtagatctttcaaaatacaaagaagtgaaagacggtgattccgtagaaattacagttacaaacagaggacagacaactaccacaacactgactggaaaagacacattatttgaaaatgcatcttatgcatactatccacttacagaagcaccggcaaactataaagaagtttctgtcgatgcagatggaaatcttgtgttcagtgaagtaaaaggtcaggaagcaacgaaagtagaaggagttacagctgaacttttaaccgaaacatcttatggagattatgagcttgatcttgatggacttccagaagaaatcaaatcagataatgtaaatgcagttgtagtaaagacaacagacggaaccgcttatggtatgcgtcatctggaaaatatctggagaggtaatgaaattgcatggagtaccggatttactagtgaagtacatggttgcccgacatcatctgaacattacaaatctatgatgggcaagaccattgacagcattgagtattatacaacaaatggggtgtatacaatggatatcgcagatatctatgttcctgtaaaatcagaaactacaaaatcagaagttgcagatgcagacattgcagcaggcaagactacaatcaatgtacagcttccagatggatttgatccggaatacagtgtggatggactggatgtgtcggtagaaggtaatgtactgacttttaaagcagcgacagagagcagagcagcagcttctgtaaaacctggaaaatataccctcacaattaaagataagaacaagaaatatgcagatgttgttacaacgtttacattgacaacaaaagatatgcctgcagcatatgatgaagagaataagaaacttgtagaggcagaaggatttgacatagatgcgcttaaagcttatcttggaaatattacttctgtaaatgtaaatggtaaagattatgcagcaagtggaagaggctccgtagttattatcaataaggatggtacgatcaagacagatgcagatccgtttaaggatgcggtagctggaacggaattccagattacagtagcttcaacaggttatacaactcctcttacatttacttacaagatagcagagactccggcaccggcagaggttgatacaacagcactggaagctgcaattgcagaagctgataaccttaaagaagcagactacacagcagacagctgggctgcataccaggcagcacttcagaatgcacgcactgtattggaagcaaaggaaagtcaggaagcagtcaatcaggcactttctactttgaatgcagcaaaagatgcactggttaaagctgaagaagaaccggttgcaatcaatactgcttctcttgaaaaagcaattgcagatgcaaaagcgcttaaagaagcagactacacagcagaaagctggaaagcactgcagagcgcactttcagatgcccggaaagcactggaagcgaaagaaagccaggaagcagtagataatgcaacaaatagcctgaacaaagcgatcaaagcacttgtaaagaaaggcagctcatctgtaaagaagacagatggtacaaccaatggatccaagacaagcggaagcgattctgtaaaaacaggagatccggcaagtgtacttggctggcttggacttgcagtttcttcgctcggagcaggtatgggcggctttgcctggaaacgcagaaaaagaaaataagactacacgataatttgcaaaaaagaatcaaattagaataagaatcagaaagctgacagacagatgagaaaaatacatttgtctgccagcttttttttataggagattccgaaggaactgcagattatgtaatttctattacagaaagctggatgacaccgacgatccttatgacattgacttttgtagtatctgcttttattgcattctttacaggaacttcatggggaacctatgcgattgttacaccaatctgtgtacagatggctctgaatatatctggtggagctttaacaccggtcgtatatgctgcaatagcagctgtaatgggtggaggatgctttggagatcattgttcaccgctttctgataccacgattttatcatcacttgcaaccggatctgatcatatcaatcatgtaacggctttttttaatttcttgctatttttttccccgaaatgtataatttttggtaaaagtatgatttttatgaaaaaaacttactaaatttctgattatcttttcataagttggtaaatgacgatatatcccgtattttagggctttatcggtattttcttttcggaagataccttgcataagctggcatttaccagcatgaaaatgcaaccaaaagtagtaaatgagtagtaaatatacgctccgatattaacaagccagtctttccagttctgcttttgcagattgaaatgtaccgtgtgcataatagccaagtgtcatggttatgttggcgtgtcccatgagatattgcagggtgtttgggttcattcctctgtttgccatattcgtacaataagtatgtcggaatgaatgtggtgtgatgttcggtaacttgtccgtgtgatatttgttatacttcttaatcagccctcgcaccataccctcatagtttcctgcaaccttaggcaagccctcacggtttaagaatagaaaattgctgtaaccacctacaatcagcggttgtgcctttcctctgttctttagtattctttggattgcttgataagcccgttctgtcaatggaagttcccgttttccgtttttggtttttggcgtttcaatatagtagccgatttcgctgtctttcaataactggtggtctatattgagtattttgttctgcatatcaatatgcgtcgtcagtccgcaaaattcagaaatacgaagtcccgtttccaacagaagcacaacctcatcataatacttgctgtaaatcttatccttttccataaaggcaagcaggcgttcttcctgctctggtgtaaggataactttatgctctgtatcatcttccagaacatcacttagtttaaattcaaatgggttctttctgatacagtcgtcttgtatcgccatgtaaaatgacgctttcaaggaacgcttatagttatcaattgttgtataggcatatcctttttcactcattctgatagcccattctttagcgtccgactgcttaacagtatcaatcgccctcatacccaatgggtcatttttcagagcgttcataagatactgtcgtcccttttcggtagccctcttgatgttctttctttggctgttctttttctcgtaaagctggcagactgtcattttaccgccgactgtgtcgataccgtcgttaaggtctttttttatctgtgcttctttttccctcaatgaaatatcatcacgctttccagcaggtgtcttgtctgtcggtacaagtttccaagaatagataaattgtggctttccgtatatatcggtatatttataaacgtatcttccgtcttttcgctggctctctccattacgcaaattgcgatttttactgtcttttcgttttacattagacatagtgtaaagctcctttccgtcatggaatgagccgtgatacgctatactttattataccatatctacggctcaatgacattagatttcgtccaatgtatctatgattttttcaaattgttttcgcttaatctgaatacgattaccgttcacgataacccagccagcgtcaatattttcttcggctaatttacgcaattttttttcgccaatgcggaagtatttagacgcttcttcaatcgtcagtgtatatttttcccagataggcacatcagtattgttcataatctatgcacccccctttactgtgtgttgttttttacaagcagacagacggctttggaaagctccattagtatctcaactattcccattcttgtgggcagaaccgcaccatgcggacgtatcattattctgtgaggataggtcgtggcaaaacgacttttccaacagtcgctctcggatcactgcgtgggtcgctcgctttcttttgaaaaggtcgtggcgtacagtccccgtggctcgctatctcacaaacgtatctgtctgctttattcagttgtcaaagagctgtggcgaaagcgtgttgctttcatgtaaaaacaggtgcagagcaggaaagaggggattgaaccaatcatgctctgcggttactgcttgttattcttcttcgatttctaaggcaatatcaaaccctaaaatcattttaataagtgcttctctgatgagtccctttaactccatatctacaacaatataaacattgccgtattcatcatagagtggacgcagacagcactttgatatgtacgggtcataaaatgccagtatcttttcaatcgctttttcgtccccgtccattgcctgcgaaagcaaatagtaggacggcttcttcattgtgtgtttcatttgctatcatttctcctttagtatttttttcataagctctagtgaattgtgtcggttttgaaaaacaccacttcttgaaatattttgtctttttgcaatctcggtatcgctcatttccaaaaaataatacatcagcaaattttctcgattacgctcagacaaatgtttcaaggcttctgccagttcatcatcacaaatacgaatatcactaccgcatacattgaaaatcgtatagtccgtatcatagtcgtcccagacagccagactttctacaacgatttctggaagttcacaaaaaagcgtttcttccttttgtcgtcgctttaatttcttctgatagtccttaacaacatgtcggacaactttcttcaaacaactttcaaaacggcattgaactgttttctggaagtcagacggtttcatcaatcgcaccccctttccgttacgacgtgaaaagtggttatccctctttccgcaccatatagggaacggcaggtgtgatttgctaagttgaaaccgaaaaaatttaaaaatttttttaggcatgaaaaaagcccgcacaaaacatatagttttatacgagctattaaagctataaaatattcagtttttaataaaaagctgttaggtagtgtatgattgtatagaatttcgcttaaaatgttccataatacaatcccccttaaagcaccttaataatgttagtgtagttttgaaaggaaactgttataaaaatcaaatcacatattttttccacctatgccaattaaaataaataatcatcaaaaagtaatataataatataacttgaaagtctaaacattataactgttttctattcattacagtaatacttacaatcaaacaaataacgaccaataaaatagttataaggactgcaattccataatcttcaatagatttagtaccaatcagcaaagaagcactttccattagagtagtcggagtgtatttccaagctttaggaaaaaagctaataagatacacacctagaacactgccaccagtccctaaaagcactcccgtataacttttaacaagaacggaaaataaaacaataagacctattatccataccccaaacaaccaccaatgtaccatagcaggcagtagtccaacagcaatactgttatcccaaaaaaaggcgttatatccataagttacagcaaagcataacaaatacccaatcgtccacattgtaaacatcacaaaaaattttgcaaatactactttatagcgagatagtcctttagttaaaataagtataagagtatttgtttcatattcctttgtaaatattccgctatacagaaacacaaatacaattaacgcaataggaatgtttttgaaaaactgtgtccacgacgtaagagcattcactgtaacttctgtaaccatcattccctgttctgccaaagaatcagaaagcgtttctaacatccacggcgtaagttttgcaattgctggattcataatgccaaaaatcaaaaacagaatacagaaaaatgtaagttctccacttctgatacattcaaaaacttctttttttaaaaaagcaataaacgatttcactttgacaccacctccataaatagagattctagtgagggttcaacacgctcgattttagaaattaatattttatgttctgtaataaattcaagcacttcaaacattttaaattgttcgcccaagaataaaagagtatcttttgcggttaattgagcgtctgtgaatacactagaaagatattcagcgtcgtctgcttttattgtttccacaataaattcgtgtgaagaacacacattttttaaatcggcaactgctccttgcatagctatttttccattatttaaaaaagcaacatctgtgcagattcgttcaacatcagataaaatatgtgttgaaaacaataccgttgtctgttttttggaagaaagtagaatatcaagtatctcctttcttccaatcgggtcgagtgcagaagtcggttcatcacaaatcaaaattttggggcgtccaagaagtgcttgtgcaatcccaagtcgttgcttcattccccttgaaaaccctctaatacgatgattttctttggaaagaccaacaagagttaaaagttcatcacttcttttttcaatgtcgttttttcccatttccaaactttctccacataatctaagatattctcttgctgtcataaaggagtaaaactctggaacatcaggaagatacccaatataacgattagttgcagtttgtccgtattttaccctttcaccagatacaaatacttcacccctgtccgactttagaagccctaagattattttcattgttgttgtcttgccagcaccattttcccctacaaaaccaaaaacactatgttcgggtacagataaatttaaccctgtcaaaacttctttatccccaaaatgtttctttaagtttgtgatacgaagcatatccacgttaagaatcctccttcccaagcaagaaataaaggataggtccaataaattgcataccaacaatcacaacaataagccataaagtacgattacctcttttatagctcttatgagttagaatatgataaagtgtatacgccagcagggctaattctgagattactaacggtactaaaaacggtaaaaattcagtaacattattcattatttttttcctcctctcgataggtttcaacacaaaaaccatgatatccacaactggtacacgtcagttttctgagcgtcatggaatgatttgaaaaaataaactctttcagatgaggtttaaatatctcatgacactgtggacagatatatactatcctttttgataaaaatcgtattataaaaattgcatatggaatcgctaccaagatatatccccaaaataaccactgtattccagtagtaatccataaaataatactaacccactgaattatatttaggggaatacctgttatcaacagaactgcgtgtaactgcttcattttctttttgttttccattgcataagctatatctccgattgattcaacagagaaattttctattcctttcagtgctttctttatgccctctagcatagcaagttgctcttgtctttcttttacttcattttgaagaagttgctcttgcttttcaagcaaaacagaaataacactgctaggattactttcagataacaattctcctatgcttttaattgaaatacctgcatcacgaagaaagcaaatgattttcagttttttataatcatcttctgaataaagtcgtctgccaccttcagaaagttcactaggtattaagataccacgttcatcataatactgcactgttctaacagatactccacaaagctttgctatttctcctgtcgtatattttgacatagccttttcctcctttctgttttcattttatgtcattacgtagcgttacaagcaatacgttacgtggggtaattttttaaacttaatgttctatcacatagtttatactgcaaatccgcttcgcaggaagcgggataaacatttaaacctttgtcttttgggtaatcttataaatatattcttctggcgtaggacgtttatttccaaaatactttttgaaatttgcctgcacctctgggtctgtactgttcatagcttcgtcaatcgttgcttcaatatcagcccgaacatcagcaaatgatacactgccagcttttgcaccagctttcaatgctttttttatatcacgtttttttagccctatcatggtatcactcctaaattcaatcgtctattactgtaaaaaatagtgttctattaggtggaatttgattgcaaagaattgtacttaaagctttccataatgcaagcccacttaaagcaccgtatcaatgttggcatggttttcaaattactctgaaaaattatgaactgttccttttggaaatgtaatggtcagtcttgtatattctttttccgtagaagcaatatccaatttcaagcccaacctatcgcataattttttcgatagatacagtcccatacccgttgcatttgccttgtttctatttgaacccgtaaaacctttttcaaatacacgggataaatcagacgcttttattccacaaccattatcttcaatcacaagcaatatatttgtaccattgtcttgactgtatatcgtcagcttattttcttgcttatcaaaatacttaatcgcattttgcacgatttgagatagaatgaatgtcagccatttttcatcagtataaatgacattttctatgtcatggatattgataattgcttttctttccataagcgaatgacggaatttcagaatgacattatgtatcacttcgtctaactgcaactgttttacaaaatagtctttttccgtattttcgcttcttgcatagtagagcatttgttccactaactgaaatattttgtctgtttctttttttaatgtgtaattttttgtattgtcaaacgtcaaagacaatgctcctatcggtatttttatttcatgggcgaaactttccacatattcttgatagtcctgcttttcttctgtgattttgccgatttcatcattcatagatttgcaggctttttttagtgcgtagtaataggcttcattttgaaattcttttggctttggtaaaacgtctgcaatataataggtttcttccagtccatctactaaatcaataatatgttgtgaagcgttacgtttcttccgatacaaacaccattgaaaaagcccttgtatgctgatgaacagaattaccagcaatacaacaaatagcatatctacaccgtagaaaatcaagagaaatgctactaaggcaagaaagaaaagctgaaacaatatctctgttattttttcttctaagaatgtaaaaaaactcacagtttccaaccctttcctcgtatattttccaataaatgaacaataccgatttctttcattttcttttttagacgagtcatattaaccagtaatacattttcgtctaaataatatttgtcgttccacagcttttccaatagttcttctttgctaataactttatcttcgttcataaagaagtagtacaaaatacgaaattcatttcttgtcagttcaatgctttgctcttgatatttcaaaatggataagtgtaaatcaagggtacaatcttttttgacaagctcacggaaattgtttgggtttgacaactgcaatgcacgcttgatcttctcaagaagaataagcgtatcatatggctttgtgataaaatcaatcccacccacttgaatacttttcaattcgtcagcatttgtatctctgcttgttacaaagataatcggtactggcatgacttgttttattttcctgcatacttcatagccattctcatacggcaggttaatatcaagcagaaccagttctatggaatattgctttaattcatctgtcaggtttccaaagtcagtcaataaaactgtttcatatccttgtgtgttcaataatttagaaagctccaaacgagtgatttcatcatcttcgataattgctattctcatttcaacacccccttgatttaccattataataattccacagcaggagagctagaaaaatctaactcgcctcattgatatttcgtttgaaaccgatatacgttgctatccagtaaatactataaattaggaagaagataattaaattcaagccaaagtacattagataaaggtgtttatctcccaaaatttgttgatacacattattcaatgacgacatcatcacgaaagaacataatattgctgatattgcagggacacaaaataatatcaataattgttttctgattgtcttaaatagcgacttgtcatttattcctaatcttcgcaaggtcaggtagcgatatttgtatttagtagagtcgctcaatgattgaactgccaaaattgtccctactgcggaaatcaagataaatgcaatatacataaacagactgactactattgcaaccattgctttttgttgttctatttctgcacctcttacgtttactctatacgattcgtcatttatttctccattttcatcaacctttactaattgatgttgcatatcttcttttatcttattttctaattctgcgtctgtatcttcttttgtatctataatcaaatgattttctgatacttcaagtccttgaacatatttatctggaagtacaacaacaaatctgccagtattagttatagagttccaataagacttagtgtcatatccttttaatttcaaatttttatttgctactgttatggtttcaatatctttgttatcttcaacctcatatgcaaacttgctatttgtaactatatagtattcgttatcatttaaagaaagcaacggcatctttcttaattctagtaatctattataatcacttaacttcaagactgggtcaaaatcataatattctgattggaaaaaattttgtacctgatgattcggctctttataaatgtcgtactcaatggtattatcaatcgtatattcttcttcaattactcgaatatattcatcaaatacctgcttatcatcaaagagttgtacatcatatggtgcatttaaattcacgctgatatcatacgaagctttgttgatactagaataattcagagccagcagtgaaattaaaatcaacatagacaatgtaccaaatgtgaagctcattgttcttgctttagaagcaaatgttcttgctacaaacagattatcattttgatatttcatttttttattctttaacaaaacagtcaagaacatatctgcacaagttgtagatataccataaatgctgataatcaacatgattacgcttaccatcaaataggtaagtgtttcttgcttattaaaattatccatagtacaacgtgaattccagagaaaaagagaaatcgcaccaagaataatacttaaaacaaaaatgacatttctttttttactgtcacggaacattttcttttcattttgtttatcaaagtaaagaaaatcacgtatcgtcattttacttattcttcttaatagattaagtaaaaccaaaacataaatagttaaaaaataaattatcaatagtccaatagaaacaaaattcaaagaaataaagagagtttttggaatacccagtaagtttacaattactaacgacacaaactggctgaataaaaagccaataggaatagctaatacaaatgctaaaattcccaacagtatattttcaattataactaagtgggcaatttcttttttcttaatgccaagaagcatatatgttcctaattctttacttcttttttcaaacataaatttcgttgtatagttgatcaaaaagcatatcacaaaaataataaggatatttacagcgaacaatgaattcttaaatgcatccatactggaacataactttacaatttcatcagaacttgccaccaaattaaaagcaaatataagagaaaaggatgcagtaacggttatcagataaatcaaataatctttaatatttctttttgtatttctatacgctaacttacctaacatttcccacttcacctccgagcaaggttaatatatccagtatttcattgaagaaatcttttctgcttttttcccctctgaaaatttcattgaatattttaccgtctttcaagaacaaaatacgttcacagaaagacgcactaaacgggtcatgtgttaccattaaaatagtagcctgcattttcttgttgatttcagacattgtttccagtaataatctggaagcttttgagtccaaagctcccgtcggttcatcagctaaaatcagtttcggttcattgattaaggctctagcacaagcacaacgctgtttttgtccgccagaaacttcataaggaaatttcgataaaatatcacgaatacccaatttatcggcgatagcatgaactcttttctcaatatcagtagggttctgtttgttgataaccaatgataaagaaatgttttctccaatcgttaaagtatctaaaaggttgaaatcttgaaaaatgaaccctagattttcacgtctgaaatcagcaaaatctttatccttgattttggtaatatcttgattattgactgtaatgtgtccgctggttacagtatcaatcgtagagatacagtttaatagggtagtctttccagaaccactagctcccatgattgcgacaaattcgcccttatctacatacatagaaataccgtctactgcctttgtgatatttccagagttacccccgtagtatttttttacttgctctaaatttaaaatgtgttccattaaaaatcgctcctttcttcctgccacatttatttgttttggaatacaattaaattatagcaagggcagtattcaattacacttacagttttgaaagtaaacagagagtaaaagagccgtgataatgcagatcacaattctgtgaagcatttccacgacccttttattataattttacctttgtctttttcgtaatggtataaatgtattcctctggtgtagggcgtttatttccaaaatactttttgaaatttgcctgcacttctgggtcggtgctgttcatagcttcatcaatcgttgcttcaatatccgcccgaacatcagccaatgatacaccgccagcttttgctcctgctttcaaggcttttttaatatctcgttttttaagtcctatcatagtattacctcatcataatttagcgaatgttttaaaaatgtttttcaaaatgtttatacagaacaatccctaaaaatgtttgcagtaggaataacccaaagataactcctataatccaagcttcaatatgaagtaacgcaaatacaaacgcaacaaacaagtacacgaaggtcattatctgatacactaaagaaccagctttcattcttaaaaatacttttctttcatcaacattattgatgtgattttctctatttatattttccaatttttctttattttttggcatttcataataacaaattttcaataattgaacaccagaagcaaaagctaaaccaagccctattgcataaaaaagtgtagagtagtagtcagtatcaataacgaaatatccaaaacatataaagattatgcctataataatttcaatgataaatggtaattttttcttcattgttaattccacctttcaaaagactacattttcttatctaaataacgagctgttataacccatgtgatttgtccgatagcaataactcctactatcgaaaaaaatacaactttactcatatatcccataaagataagagcaaataatacaagaaccaataatgtaagtgttactttataagcattcgcaagagaagcattagtaattgcgatatttctttcatcattttctaatatttgcatttcttttgtcggcttactgaatatatcacaccccattaaaatcaatattattccaataagtgttgtaccatagacaaccaaatctggacgaggtacaggtaatagttgatgtactcctaaaccataagttagtaaaccacctaaaagaactattacaccgacaaataattctactttttgtatcttatgcttcatttactttcctcctcataaataaaaatttcttcaatgctcatttgaaagtaccttgcaattttaaaggctaacataatagagggattgtagcgtccattttctaaagagcctattgtttgacgagatacttcaagagcagtcgctaaatcttcttgtttaatacctctttgttttcgtaattcttctaaacgatttttcacaacatacccctttcttgaacgaatggaaagtttactttccttttctaatcttatgatactcctgcgagcaaagaatgtcaagcaaactttccatattttattaacctacaatcttccagttgctatccttatgtaatacaagctcatactgcgatacttgcgtcgcttttgtctgattatcaaggaacttcacggcaaccttgacttttacattgtcgccgtcctttataaagatagggtttaccaattcagaataaaagtagtccctgccgataggttcaagcacatttcccgatacatagtaagcaagttctttttctgtagctgtcgggtagagcttaaagaatgtttccaaaaatgaggtagcgtcatttacggtatcagcgtccacgcttgcgtctgcttctggtgtctttggctcatagtctgatttttcgattgctggtgcaagggtagggttctgaacgattaccatatccccgtcagcgtccacatggactttcacggtataggttgctttaattgctgttgtctgttctccctcttttatctgctgatctacttcgtaggtggcagaaaaagtgtccgttcccgactgttcgatattccacacaatcacatctgtaaccgtggaactggtcggtatatcggttctaatggtatccacattcaagtcctgcaattcctttgtcagataaccgttgattgcctgcgttcttgcttcaatcgcttctttgctgttattccatgtgtaataggacttcgcaaagttcttcacgaaattttctatcccgttggtgtcctgcaagcgaagttcaatgatttctttttcatgggtcgtgtgctggtcgatagccgtaaaattcttatacaccccgaagctcacgcttgcaataagtaccacccacaacgcaatcacggctttcttatgtgtgcctaccttaacagtacgcacctttttttcttttggttctttgatagtttctgtctgtttcttattcttcttaaacatattttcaagtcctttctattgttttactcgtcctgcaccgattaagtgctgttgccagtaactactacttaggtctgcatatcctatcgggttgcctgcatggtacatctgtgtcggcgaaacgagaataccaacgtgtgttacataacttccagcattataggtagaatgaaaaaacgccaagtccccagcctttgcctgcgaaagtggaagatgttgggtagcgtcatactgtgcttgtgccgttctcggtaaggagataccagcttttccataacaccattgcgtcagtcccgaacagtcaaaagaagtgttgggattgctaccgccatacacatatttccagccttgatatttcaacgcttcattcattaccttttgtgccagctctcccgatacctgcgaaacagttaaatactgattgactaattccacatagaacatatttccatagccataccgccagcccccgttcttcgcaacagctatcgggttggtgtaggttattttctttccacccgatttctcacgagcgaagctctctgcaagattaaaagtgtgtttctttccttttcctgccacatatcccacatagccaccgccatagttataggactgtatcgctacattcaaatcgtcgataccttgatttttgcaggaagaaagcagggacgcaaaatacttacacccctgcttgattgaactttctgtatctaaagagttaggtggcaaaccaagactttccgaactctgcataacatcttctgccgtaccgccactttctacttgaatgatagcaagcagtacattgacatactcggagataccgttttctctggcgtatttttccaccataggctgatgtttcaaaacttctgcggataggttcatacccgtaatgccagaagaaaagttgctgttctcgtcgtcgctgtccgcactaatcaagacaccaaagaaaagaactacggaaaagaggataggaaacagactgccaatgatagcgatatgtttcagtttcattttttcttctgtcctttcttcgttacaaggttacgagttttctctgtggtctgctggttcttctggacgctctgcgtctgctgaacctttgtcctgcggtctttggtgtaattctggcgtgtttcctgcgatactactttttctacattctgcctatgtgctggctgtgccgactgggtcgcttttctatcagaagcaccagaagataacggacgctctttgataacatttgtcttgactggctcacttgcttttgaagtggtcgctgtggcaggacgtttcacttcctgcgttttttccgcactcggttttggaatgattgaagttgtggctggtcgctcatggggacgggtagctcccgttgtcgctgatccgtccgtctttcgtgcctgccttgcttcttgtgccttttgaagctccatacgtttgtcagcgatatttttcttacgctgttcctgcttttccaatcgtcccgactgtctggactgctgttcctgcaccatgccacgcttgaagtcggacacgctggactttgccttttcctttgcggaatataccgcataagcagtctgtgtcggtatatccttgatattctctttgacagcgtttgccttatctttcactttatttttcgtatctaagacagcacccacctttgagcctgcacgctgtcccatgctggaagtgatattgccccgattttctttagaagctgtattttttctttcagccctcttgccagcaacggcacttccagccaccgcaccagcgacaccgcccgaaataccgccagcacttaccgcccttgcaatacggtgttccatacgcctagctctatgtcgcataaacagatacggtctgcggaaaattcttcgtcccatgctttgactatcattagcgttcaaagagaacatactcattaaatcgcccagcttcatatagataccagcaaaacatactatctgcaagaacgccaccatgaagaacggatagtccgtggaaatgttataaaacatactggaaatgctgaacgccaccgttacaatgagcgttattcctgcccgtgtcataatggtattaaacaccctcacgattgcctgttttaccatgctttcatagctcggtatcatggaaagtagaaaactgataggtaaaaacattgcaaagataataaaaagtatctggctgaacaacatcatgcccgtaagcaagaatacaaatatcgtgatacctaagttgaagaacaagaggaagaacaccatgcctaaacggttcacgacctgcggtatcgtcagattgttgttgtcgttatcttcgatttctgttttcacgacttcctctctagttttcccatcctcgtcctctgggcttgccgatacaagagcttctacacggtctgccccgatttcttctgcgttgctgttcccgaattgcaagagtaaccacggctgttccacttgaatagaaaataagctgtcccgtatcaagtccacgctatccttgccctcactgtcagaattagggagcatgattttcgttcccaagtctaaagaagcggtactgatgtctgatgaaaattcatttatcttcttaatgtagtcgggagcataggcaataaatgaagcggacagcacgaacaccaccacaaagttgataacagcgtgaagtgccttgctggtttcccgtttgataagtcccgtataagcaacataaagtcccaccaccaagataatgagaagcagaaagccaacatagaagccagagctggaaaagccgtttgaagtaacgcctgcaagggtctgtatgctctttccgatactgtctgccatatcgttaataaaatcaagtttataggcttcctgcaccacatagcccgttgcattacttaaataaaggcttatcgtccagacaaagttggtaatacagtaaagtccatactgtaccgattttccgataccgtccagccagttccacggaagccacgaccagctattatctacataaaaatcaagctggtaattcgacaacggatattttgaatacagattttctgcgtttatggtatcgtccacaagccccgttgcatgagctaccgtccccagaagtgaaagcaggataagggagagtgccaccacgaacagagccattttgagaaagtggaaaatcttcttttttgtgaacgcaccttttaccctttctttcatcactccacctcatttctctgtacgggcggtctggtatcaaaggcgtgtagcagttcttcaaagacggggtgtatctgtaccacaccgacacgtccgtataagtcctgcaataagcattgtccgttctccaaatcacgaagccgtttctggttgttttcgtcgtccttgtcgataccgaaaaattctaaggtctgttttatctcgttgacgtcagtagaacgaaaggcaaatttcaagccgatattgtttttcagactttcctttgacacgtcgccagaagattgtgtaacgaaataaacgcctgcctgcatagctcgcccagcacgaaccagcttatttgataaggtttctccttgtgccacatttaagaacgcccacgcttcgtctaaatcgacaatcttaaaaatgcttctgtccgaatggataaaatcaagggcaaaggtactaatcacaatcagcatagacacagacaacaattcaatggtcgtgtattcttcaaaagtggtatctttatctggcagtacaaggtcggctacttgaatgatattgagctgattatccagactgatagcattttctaccgtaccgtctgaaaacagcaggtgtgcaaagtcgtagtccgtgaagctgtcgatatggtctgcgatatttcttgatatgggcgtatcttcacggcgtagctcgtctatcacatggagcaagccccgactgtcgctctgggtaacggagcgtactgccttacgaagtacggggaatttttcgccgtcccttgaagaaatacccgtaaggaatgttaagatgtcgattgccagactttcagcgtcttttacattcttcataatcacaaacgggtcaagaagccctgcattgtccttatcgctggtaagatttacgatattgatttcatgtgcaatctctgggagcgtttctttccagttaccacgctcacttttagggtctaacagaagtgcttgaccgccaaacagcaccgcataatataccagaagattgttacagaacgatttcccaccgccaagcgaaccgacaaaagcagacgctaaagcgttggtaactgtaccttttacaccttgactggcaagggacggttgcaggtacacatttcttcccgtatcaacagaatagcccatatagatacccgtagtttctcctaactgctgtgtcgcaccaaagccaagcccagctaaaaaatctgattttacatactgcacatagtcattgatatatcgcttgctggctggtaaaaattcagaatgaagccccagcatatccccagcaggacgcaccagctttacattgaggtcgtcgtaaaagtccttgacttcatcacaacggcgtttcagctcgtcaagatcgggtgcagacacccgtatgacgtagcttaacttatacatactttcttttgtctggtctaaatcagtttccagctcgtccacgctgtctaaagcgtccaccacatttgagctggtttcacttcctgcttgataggcgtgattatcaaggtctttcagttcctttttcttgttgcggacggtcgttaatgctttccgattttccacgatttctacattcatagaagtatcaacggggaatgtgaattgctgttgctggaaatagaagatttcacttgacggaaaatcaagctcgcctacaatcgcattgacggtaaaataggacacataactttccttgtcctcatgttccaatcttaaataccgctggctttcctcaatcacacaccttgtcggacggataaggtcgtagtattttatcagcgtttctttgttcaatttcttctttggtagctggtactcataatcttcataggcaataccgtccctgccgtaaagatgttccatgagatacccaaaatcattgatttccaagcgacgcaccttaaagcgacgggagattttattttccagtaacttttccattttcatgtaacggttgatttcatcattcggcatggaaacaaaatcattcatcagcgtgtggttcacttcatggagaaattccgtgaacgtcagccacgccgattttttgatgttcttcagattgagctgttcttccgtaaccatgagcttaaagccaagaaaaaagcggtagtccacttgattgtccccaatcatagatactaacgcttcggtctgttcgtctatcttctggcaggcaacttcctttaattttccagttaccagtttctttgactgttcctgcatactgcggattgagctttctgtggcaatctgcaacgcatgaattttaccctcacgggactgtgcgataagctgtcggaaactgtcatgcacaataaatttctgctctgcggatagaaaagaatagttgtatggtatcagctcatagtaggcgaacacctcattgtccttgttccagacaaggttattgtcaatatattttatcgggaacatagttcacactccttactgccgtgattgtttcattcaatatctgcttatgcagttttacggcttttcctgcataagtgatttttggtcgcagggcataggttatctgtgatttcaaaaagctgtacggcttctttccgtcaaaggttttctgcgacatgaaccaagtgagagcaacgggaataccaaagtatttgagaaatgctccctcaatcatggaaagtgggggaatatccccaaacagaatgatgataaattccgtaatcacaaaccatgtaatctgtgtaaaagtaacgggaaagggtaagttaaagtcattgattgcatataagactttttccacgttccagatacccgtgtagcttttaatctttttcaagttctttcagctcctttcaaaatagaaaaggacagccattttcagactgtcccttaaaagagaaatacgctgtcagtagcaacaatgcttgtcgctgatcttccagcgttaatatggtatctcgcacatacctcggcttgtttcaataaagcaaccgcccatatccaaatctcgcccgtaggcttcatagtcaatgtaattctgtaagctgggtggaatgtccccaagtgcctgcaattcgtctatgtagtagtaggcaacatctgtcatggtttcacagtcgggataatagtaaatatcgtccttatgttccacgacttcttccagcgtcccatagtggctgataaattcgtccagacactctacgatatagtcgggaagttccgctatcatttcatacatctcattgagttcttcaatggaaacatattcccctatgccaatggggaagttgtcggtatcatggatagcgtattcctcatactgttcattcaagccgattttttcttttacatcttcctcgtcaatgggaaatgtgaaccaagcaccgactaaatagccctcgttgtatttgccaagattagcaatataaaccgccatatcatcaatcataagcacacctcatttcctactctggcagttcaaagataccgtgttctgttactaaaaatttcccgtgttcctgcaagtgagaagcgtaggcttcaaagtcaaagtaatattcttgacagtcctcggataaatgcttaaatgtcgggtcgttcatcagcttttgctttgcaacatctatcatgcttttgcagtcgggataaatcgtaatcacgttcctgcaaatataaagtgcttctaaattctcaaacaccgtaagtagtgatacatattcttcttgcatatcacttgaaagctggcggtacataaaatctaattcgttgagctggtacacgcttgtatgttcgtggacttcatcagcataaggcaacaccttttcgataatacggtaatccccactttctgcaccgatacctaacttttcttcaaactcggcaacatctatcggcagttcaaaccagtatgatattgtttcttcgccagttgttcctttcgtttccaccagcacccttgtttcctgcattgttcctcacgtcctttctgttgtttcatcacatcttgtaaggtctggtacgacataccaaacacatactttgaaaaatcttctaactgtttttcttcatagtcggcagggttcagtcgtttcatttcctgccacaccttacgcttgtaagagggcaggtcggaaatgtattcacagccgacttttgcctgcatatccttaaaaatatcgttcatgtcatcactccaatctgattttaggtaagaaaaaagcagtcaatcctaagactaactgctttatgtatatggatataatttgattaagttttaaaaccagtttgttttttcatctctaaattgagggttatcgctgtgttgatatggattatagttattcagattgcaaccatattcttttaatgatttgattttgttatcttctgtccattcaattaaggaaataccgtcaaattcttcaacgcttcccgtattcatttcatttttaaaataccattctacgacagtttgattttctttatgaaagaactgtttaatatcccaaataatgactttaccacgagtattccattcattaaaccaatgttttactgttttaagattttcatatttaggacaccagctttccgtataaacaacatcttctgtaaaaattttatccattcctaagtcttgctgtttcaaccacatatcaaaccataaacgaataattttttctctctcattcaaaatagaacacctcgattacttcttttttcacattatagcacccatacatcagccccacaataaaattttatgcaccgataatcttattgaacagctctaacagtacatctttcacaccgccagcattgaataccaagccgacagcaatcaaggcaactaccaaaaagccgataagtttggaaaactcacgcttgaaccctaagtagataccgataaccacaatcgccataagcactaagctctgtgcgtttgataaaaaccattgatacaaattttgtccgaaattcatttaattgtcctcgctttcttttaattgtttcatttcatagtcagcttctttgccgacattcaaaatacacatcaagactacaccgatacccattcccatagataccagcaggaaatcttttaataatacccacatttttatcactcctaactttctactaaatcttttgcaggggtcgtctgctgtttgattatcatttcatgcttttctgtgagctttgcctgctgttcgattgtttccatgtaatctgtaccatttcccttatcaatctttttcagcattttcaaggtcggtgctacctgccgttgtacccaacgcaacgtgcggtctaaggtgtacggctctggctttgtcgtcagcttcaagctctgtctgttatcgccgataaaccaagcccagcggtcattgagtttccagtcgctttttcgtttgtcgggttcttcatcaacaaaccgcacatactggttgatgatagaaaaggcggtctgctctgcgtcataatacgtcagcaaatctcgtactgcataataggcacgttcattccgtagccgtatctcaaaacggttgataatatcggcttcttccagcggtatcccgaacttgacgtactgctcatagtccttttcatagatacagaaatacacatcggatttcagcgaaccaagataaagggtacgccccatatattctctgtcgtcctctctatgcttgataagctcgcccgacaagtaaaacttgtaacttctggactttccgatatattcccgtttcctgcatttttccgcaagctctggaatatccaaaatgcccatatggtcgttgatagcaaggtcgatacgcttcataacaccaccgtctacgagtgcgtccatgagaaagtcataccagcttctttcctgtgccagcaagtaactttcaaactgtcggcaacctcgcccctttaactctaaaaggacacccttttcttcgtcagccgacgtatagataaagatgtcccctaaagaataatgctccgtataactgtaatgtccgtaatcttcatggagcatatagttgatattcagttttaatatatctttgatgatgtgctgtatatccagcgtgggaaaacggatttttacataatcaaacagcatggtaagcggtgcttctggattgaactttgccagttccttttgcagagtattaagaagttcctttgacggcttcatttttccgctttctatcttgttgagatattcccttgtgataccagaagccaacgccagcctgccttgtgagataccgtaagcaatccgtttctcccgtaattcttttattccttgttcttcattcagaaccatacccccaatctgtaaagtgtgaagttttttaaggcgacttcacatctgaattttgcaaggaaactatgcgataagccttatgtttcctatgttttttgtctattgtccatttgcaaacgtacccctctgttagataccgaggggttttacctgctggcgtggctgacgccacaccagcaacggctagtccgtgccgtcgcctttcgcttcgcacgtcgccgtcccgtcctgccttgcttgtgcaagagagccgatagtctgcaaaaaatcatgtcctttcgggactaaaggcgtgtaaaattcgctgataacacttgtccctacatcacaatagccacgccctttgatacgcttctggaaaaactgctttttcacatccgaaccgaacagcataccataacctaattcgctgatacgcccaagtcccacacggaaattgaagttatctctgataccgtccgagaaatactttgcgtctggacgctggcaggcgacgataaggaaataaccagcctgccgtcccagcatgacgattttctttaactggctaagtaagctcacactttctttcgtccccagcatttcaaaaaatgccacatattcatcaaagataagaaagcagggtggcagtcccagataggcgtagttttcgccagtcttatagttcgggtgtcgcttcatttcctcacttcgctgtaccatgccctcataaaaggcattgacgcagtctatcatttcttctttggtgtgatatacatttcccataactgtccctaagtccgcaaggtcagcgttcttcgggtctaagatgtaaagaacagcgttggtatgcagtaaggcttcaatgagcgtcagcagaaaatatgttttaccgccacctgtaccaccagcaatcaaggcgtgagggagtgcgtcatattcccagacaagatttttcatcaatctaagacagccgttctctgcacgtacttcattaatggtaatgcggttcgctatcatatcataaagcagggtatattcaatatagccgtcatgcagggtcttgtcagtcagctcgcaatacaagccactttccagcttatcctctaaccgtaaaagctggtcttgatattttcctaatgtgatttcacagcggatatgaagcagtcccttttccatttgataataaatcttcggaaaccagacgattttttcccttgatctgctttgcaggtcagtaaaaaaaccgctgtcttgtacggtatcggcttcataccacttattttccagtatcattcttgccagcttttgacggtgcaggagcttcttgaaactgtcgtaacagaagcggtaatacagaaaagcgaccaatgcacaaacaccagtcgctatcagtatggttatgaagttgtaaggggagagcgtcaagccgttctcaaacaagctgaaatgctcccaatcggcacgcatgagctgttttatattcagtagcaggagaaccgccacgaatacaaacagaagcgtccctatggaaaaatgatagacaaggtgcttgtcactggctctgatacggtgtcctttgttccaaatcatacgcataaatcaatcactcctttctgggtatgaaaaaagcagtcaatcctaagactaactgctttgtgtatatggatatgaagttgtcaaactgtaattttgttatttcattttttcttgacactcgctacattctttatcgtgaatagaaataatgccaccgcatttaggacaagtatattttattttctgctgttccatgaaatgttccaaaccatgtccttgaacaaaacggctattttctataagacttgcttgataccgtttattatagcttttttcaagatttttaatcaacttacatggatattcagcacattcaaaacaataggataacgattttcctttgatgcaatcctttattttgcatttacgacaatgttctggtttccctttatcactattcaagcacccagaacaaggttttttattgtaacagtgcttataacaaaccttacaattcattccgcacggggcaaacatgcttatatcaattttttcttttgacattttcatagttgtttactcctttcaacaatttatatttgtccgtttcttcatatccatattataacagttccatatattcgctacaatgaaaatctattcagcaagcctattttttcggctgtccctgcggtgtagagttctgtggattacctgcgttctggttgcctttattcttcaacacaatatcctctgcctttacataccagtccacatctgcaccaccaaacgtctttcttgataccgtatcggctactggattgacaagctccacaactgcattatacggaaattcccttaacggcacttctggcggtacggacacggggataattccaccatgcagactgcacttcaaatcatagatacgctttttaagctgggtactcggtgtcccgtcctcattctgcaagaacacatcacgcaccgctgtaaattttaattctccaaatgttttctctttgtcaataacaaatccgtttgataatctcataaatgcttcactcctttacttttcttcaactgctacaatatcatcagcaagcaacacataatcggtatgtcccatatcgccgattgcgtaacctctgccgtataacttcggattgacaagttttactttctgttcatacttgaaatgcttttcgccagcctgcacgggaatttccacgacaacattttcgcctttttgtacgtcagaataaaggttatagcttcgtctggttaagaccctgcggttatttttatctttttcaaagactggctcactttcgcctgcaaattcaagagttccaaaagactgtgccatatctggcacgacatatttcatctccatattgttttacctcgtttctttctatatttgataagttttttaattgtgatttcttattctggcggtttggaaagtaccagcaatcccccagatagtaaagggtaaaatcaatgcttacgcacccttgactatccgtgttcttgcaggttgtaggcagacaagccagaataagcaaaaatctgccgtttgacagcttcggcggagagcgtgatttttctttcctcataccgttaccgccttatgatttcttcattttacggcgtttgtaaagatatgttccagccagtccaccagcagatgtaagcaacatcacaagaaacgccatgacatttgtggtgtcgcccgttttgggactgtcgttcggtctgctaggcttttctggtgtctgtggtgtttcgggtttctctggttcttctggcttttccttaaaggtaatcgtctgtccctcgtcctcaatgtccttatgctccgtaactttcttcggctcgtctggattgcttaaatcgtacaattcctcaaaagttacaagctgtttgccgtcaagggaagtagcgtcaaaggtaaaggcaacttccactttcatagtttcgctgtcagcggtaaaggtataatcactttccacacgttttccattgataagaagctctgcattttcttctttcaacatctgccagcccacaagtttgtactgtgtaccgatttctaagccctctaaagttacggtatcaatgattgtaacgtcttttccagcttcaatctctttgttaccgtccttagccgtagccgtcgtatgaattttgatgatacgctctgtgataagtaccgtctgcccgtcgtcctcaatgtctttatgctccgcaacttttacgggttcgtctggattgctcaaatcgtataattcctcgaatgttaccagatttttaccgccaagctcggacgcattgaatgtatatgtaatttctattttcatttcctcatcatcagcgacaaaggtatagtcattttctacacgctttccgtcaatgataagctcggcgttttcttcctttaacatctgccagcctttgagctgatattttgtgccttttgtaagtccgtctaatttgactgtatcaacgattgtaacctcttttcctgcaaggatagtcttttcgccgtctttgctggtcgctgtggtatggatagagatttctttttcgtattcatcagtcagcgttcctaaatcaatcacaaggttatttcttgataccacgatttcaaaaggtgggataagttcaaagcctttgttgctatcgcaacgcatttcttcaatgatataagtatcgtaaggtaacgcacctttgctgtcgtctggttcagaagtcccaaaccatacaccgtcctcgctggtcttgcctgcgttggtattgtgcttatgggaagcccagtcagcagaagtggagaattgcccgttatcatcagttactacaacatgactttccccagtcgtcttgcttgtgatcctaaagggaacatcagcaagacgcttgtgtgtgcctgcaccgatttttacgccctcaatatctccacgcttaatctgattgtagatagaatgggcttcgtcggttaagtccacgatttttccattctctgtgattgcaaaatcaatcggttttgcaccgtctgtcaaatatccgtttggagcttcactttcagcgatacggaattttccataaggtaaaaggtcagcagaagtagaagcgacaccctcaaggtctgtatggattgtttttaccacttcatttttcttatataacttgccctcaaccaatactgcattatcatttaaggaaatgatgtcaaaagcagtatctttcaaagtggcacttccttgtggcttcgtatcgcccgtttctaaatctcgtttctgaattttgacaccgccacggataaccttgtctgatacggaaaactggttacttccagttaatacggcaaggtcgccgtcctctgtaatctgtgttacatataagcccttaatctgttcggacttatcgccagcctgcatatatgcaccgtctaacaagtagccgtttggagctttcgtttcctcaacggttagcgttccaagtggaagaactgctttgccgtcctgcatatagaagctgtcgccagataccttgtaagcgtccgctaattttgtgatgtagtgggttgtcccgtcgctgtttgtttcagcgattgtttttgtaacccatgtacgagtagcttcggcagggagattatctttattgtagtagccagcataatacttccatgtaaattccgcacctgctaaagaagcgttcccttgcggattgtctttctgtgtttccatgtcaatcttgaaaagctcaatcaaagtgtccgttacttttggcgtatcagatactttcaaagtcgctgtctttccagcttcaacctttaaggaatatacagttttatctaccttatatcctgctggtgcggataattccttgatatagattgtgcttgcttttacctctacaacatctgtatttccgtttttatcagtcgtaagagtggcaagctgttttgtgcagtccttatcagcaaagacaccgtatgttgcaccagcaatagagtaattttcgttaccgtctgtaatgctggtattactggaagtcttttgcagtttcgcatttccgacattcagcttcgcccagaattgtcccaattcctgcccctcgccagagtagatataaccgccacattcatagcgtcctttattctctttgacaaaggctttcgcaccagagaaaacttcgtcctgcgttgcctttggaatttcatcataagaagctcgcacgttatcacattgccagccaagatgtacgctcaatctctgccagactacacattgttccaacagatagacttgcttgtagttcagttccttgtgagcttcgccatactgtttgatatactctaaggataacgccacatctgaaatctggtcggcactcatgcgtgagcttgcgtcagctctggtcttgtagccattcttaaaatctgtattgatgtcaatacaataggcagtttcgccctcaactttcatcatgccctcattgaatgtagaaccaatcgaaccgtcattcattactttttcaatgataccgacacgctctgcactttccgtccagtattgcttactttctgcatgaacgggtgtagtcggtaaagcagtaacgacagttgcaagagctaagaagcccgtacacaatcgtttccatgtctttttcataaatctaatgctcctttcatttttggtaataaaatagccgtccaataagaacggctggaaatagaaaaggaacgtcattttaggcgttccatagtctataaaatattcaatttttttcttgtttcaatactgatgtgctgtaccatatctttgcatatctaggaaaactggcgtatcaaggctcattcaatggtagtaaataagtagtaaattgatgtatttgttcccttgaaaatgctgatagatactgtgttttagcggataatcagatttttattgtgttttttgcatcaaaagtatagtttttgataaattctttatcatgtcttatctaaaataagaagtaggaagattatcaggaatggggaaaatggtatgaaattattaaaacttgtgattgtagatgacgaaccaatccttctgcagggactggttaagacgtacaactggaatgagatgggatttgaagttgccggtcaggcacagagtggggagcaggcaatcgaagtgatcaaaaaagtgaagccacatgtcgtactgacggatatccggatgaaacaggtttccggtctgatggtgatggaagagatccagaagacagagctggatccggtttttattgtgctcagtgcgtaccgtgattttaattatgcacagcaggcgtgtgatcttggtgcatatgcatatctgctgaaaccaatcgaggaagataaactgcaggagaccatgcagggcgcataccagacctgtatggagaaactggagagcgaagaacgttatgaaagctgggaaaatatgatccgaaaagattccaccagttttctccaggttgttgtacagaaatatttacagaataaaatttcctatgaaaaggtgcaggaagtatttgcgatcttgaaagatgtgatcgaagagggcgaccgttttattgcaatgtgtgtggatcttgatcttacatataagattacggatgcactgaattacgaagcagccaggctggaattgatacaatctctggaagaaatgttttcagagcggtattttttctggcattttgaaaaggcagaaggttgtcatgtatttctgatcaagacaaaggaaaatgcgacagtgcgcgagattgcgcagattctggaacaggttaaaggggaacagaaaagtccggttactgcatcgatttccaaaccgtataaaggactggatggaatccgccgaagttacgaagaggcgcagggacttttcgagccaatctgcagcaatgccacaaatgagaatacttttcccatacctgtgaaaaaggaagaaaaagcggcaaaaagtgattgtgaagaggcaggacttacgatcgtcaatgctgttcggaagaatacgtttaaagagttaaaacaggcttttattgtgttgatctacgcacttccacatgaggaagagttacagatccgttatatacataaggttatgctgcaagcggagatgatgctgaacgatacttacggaatgacggaaaaactgcagaaacagttccgaaattattattcgaatatggagagtctgacagcagcacaggcggtagatgtcagttataggatcctcggagaagcaattgaggaacgggaaaaatatgcagaaagcggagaaaataaatgtgcaaaggaatatatgacagtggcactttcttatatcggtgagcatttgcaggaggaagaactttctattgttcaggtggcaacgcagatttatctgaatccggtatatttcgggcgtgtatttaaaaatacatttcatatgacctttaaaaagtatctcttacagcagagaatggagaaagcaaagagactgatccaggatggatgtgagagtataggaacggtatgtgagcaggtgggaatcagcaatgcatcctatttttcacatttatttaaagaatatacaggaaaattaccgagtgaatacaaaaaggattacgaagaatgaagaaatgggtgattaaatccggaatacagagaaaataccttcgatatataatggggctgttgttgctggcaattttgctgtcaagcatcggtgtttggatttatgtaaggcagagtttgaccacagaggttacagataaatatgaatttttaaatgagaagatggggctggctctggatacactgtcaaaagaggcggatgaagggacagcagaatgtattacttacgatcaggttcaggaaagtctgaaaaaagcttcatttgcagatgtggaaaagaactctcttcagaaatattttgcctatatgaatctggatcatgtggcagaatactgctatgtggataataaaaataatgtttatgccagatcctactcgcatattgattatgaagatttttcagacagccatctggaagattacatgggagattcttatgcgaaaacacaatggttctgggcgaaggatactctgtttgggacggagaaagaagcattgtttatcggaagatatgtacacagcatggaatacgccagcaaaccaggactgctgctcatcaagatgaatgacggctttctggaaacgatacttggaaaggatcggagtatgacagatgaagtgcagatcggaattctggataagaagggaaatttatgcgctgcctggtgcccgaaagggacgaagatttcggatgcggtaaaacaggaagtctataagatcagcgcacaggaaacgagtggtattcttgcaaaaagccggagagtgagcggtggtgtctgctccatttacaaagaaagcagctctgaaatgacggtgttcacagtcgttccgtcgagtgtaatgacgcagggaacgatgagggtacttacggtgctgatcgggatttatctgtttgtggcagtggtagcggttgtgatcagtatctatttttccaagcggttcaccagtccgatccgggagatcagtgaagagatgacacagtttgacggaaatgatttcagtcgcctgattgaactgaataccaatacagaattggatcagatcggacattcctacaataagatgctaaaaaatattgagaatcttctggcagagatcaaagaacaggaaggggtgctcagacggacggagttgaacatgcttctggcacagatcaacccacatttcctttataatacgctggatacaatttacatgcttgcgcggataaacggagaagagacaaccatgaagatgattcaggcactttccaaatatctgcgtctgtcactcagcaagggcagtgatatcgtgacggtggaggacgaactggaaaatgtaaagagttatatggaaatccaacagatccggaatgcaaatctgttccggtatgagattgagtgtaaggtggaagagaagagtacgtggatgctgaagctgatcttgcagccacttgtcgagaacgcgatcaagcacggattctgcgaaatttatgagaatggtctgatccggattgagattgcgagggaggatagccagctgaaaatcgtggtattcaataatgggaagccgattgaccgggaaatgatggaaaagatcaatgccttaaacgggcatccgattctggaggcgaaaaaatgcttccaggataaggaacacggatatggagtggtgaatgtactgaccagactgcggctgaaatatggagaggatgtgctgttttactatgaggcagaagaaaatggaacccggtgtacaatccaaattccggatgacggaaaggagaaacgtgatttatagaaaatatttgcaatcggtgttttgtatcgcactggttctgacagtgctgaccggatgtggtaaaaatacggggcagacaagccggagtacagaaaaaaaggagattgatattccgatcattctgacggtagatccgacttccggcaagaaaacggaacaggatgtcgttgatgcatttaatgaagaatatgccggtacgtatcatatgcaagtggaatggatcatggagacggaagaggaataccgaaaaaatctgaaacggttaaatgtcacagacgagcttccggctgtgatctatgatgtgcgcaccctgccgtccttttatcagatgatggttgcggatggacggatcgagaatctgagtccgtatctggaagaggatgaagagtggaggaatatgatcgaaccggcggtgatggaaggctgtacggatgaggatggcaatatctatcttggaccgatcagtacggcggcatttgcgtgcgccggcatgttttggaatccggagctttttgcggaagcagggattgagaaattcccggagacatgggaagaattctgggactgctgtgaccggctgcaggcaaacggaatcacaccgcttggacttcacactgaaggaaccggctgggcgccgatgctgattgcaacagcagaggcagcacacacggaagaaggctatgcatttatgaaagagcttctcccagaaagctattccaatgataccggtcttgaaattgcagaaaccttgcagaaattgtttcggtatacaacagaagatgcaattcatgctgactacgatgtggcatacaataattttgtcgcaggaaaggtggcaatgatcccgaacggatactggatgatcgaccagttgccggaagaatggaaagaaaaggtaagattttccgcatttccgggaaataaactgatcgcctcaccggaaaccgttggctgggcggtggtttccacttacagcgaggaggtcaaagaaggagcggttgaatttttgaaatttcgcacgaaattcaatctggaagagaagaaagagctgatggacaagaacggacgcactgaaatcagccagctccttcaggattatgtaaatgcctacaataacaatccgcagatcgttccgaactatcaggtgaaatggaactccatccttcaggaagagacgatcggggagtgcctgccacagcttgccgccgggaaaatgacgcctgcgcagatggtggagactgccgacgaaagtatccgggagtatgagaaagagagatgatgggaggagaaggctgttggtgtcattttatcaataacaaattttttacatttcgaaaagtatattttttgttaaaggaggtttgcgatttgttacagtctttgattggattcttgctattatttaagcatagaaaagaaatccagacgaggaggaacggaaattatgaaaaacaaaaaaagatggctggcactggggctggtaggaatcatgacacttggatgctttgcaggatgtggaagcaagagcgatggcaagagtgcagacggtaaaggggacagcagcaaaggatctgtatattatctgaacttcaaaccggagcaggatgagcagtggcagcagctggcaaaggattacacaaaagagacaggtgtagatgtaacggttgttacagcagcttccggaaactatgaaaccactctgatgagtgaaatgggaaagagcggagcaccaacattattccaggtaaacggacctgtaggacttgcaaactggaaagattactgctacgacttatcagattctgatatttacaaagaactcacaagtgatgattatgcactgaaagacggagattctgtagcgggtatcggatatgttattgaaacatacggaattatcacaaataagacattattaaaagaagcaggatatacaccggatgacatcaaatcttttgcagatctgaaaaaagtagcagaagacattacaaatagaacttctgaacttggattttctgcatttacttcagcaggtatggacggatcttctgactggagattcaagacacaccttgcaaaccttccgatctactttgaatatcaggatgaaggaattaacacaacagatgcaatcaaaggcacatatcttgacaattatcgcgatatgtgggatctgtacatcaacaacagcacatgtgatccaaaggatcttgctgcaaagacaggtgacgatgcaagaaatgaattcctgaataaaaaagctgtattctatcagaatggtacatgggaatatacacagctgatcgatggcggtctgacagatgatgacatgaccatgcttccggtttactttggtgtaggcgatgaagcaaaccagggactctgcacaggtacagaaaattactggtgcgtaaataaagacgcagacgaagctgatattcaggctacattagattttatggactggtgtgtaacttcagatgaaggaacaaaatgtatggcagacgatatgggattcaacattccgtttaagaaagctcaggaatctaagaatctctttatcaaagaagacaaacagatgaccgaagacggaaagactccggtagcatggaacttctcaacaatgccttcagaagagtggaaaaatggtgttggatctgcactgacagcttatgcggcagatcagacagatgctaactgggatgcagtagtaagtgcattcgtagatggatgggcatctgaatacaagcttgcaaatgaataaataagttgcataaaaagaactgacctaggggcaggcggcttgcctgccccttttaagtgagaggagagcctgtacgaagcgggttttctggatatgggaacctacgtttttccatataaaaataaaaagtgaaatgagagccacctggtaggaagatccttccgggcaaaaggaaaagaggaggatttctatggagaaggcactgaaaaaacatgcaccaatatttgttctcccaacatttcttgcatttgtgatcggatttattattccgtttgcacagggattttatctttctttttgtaagtttacaacagtaggaaatgcaacatttgttggaatatcaaattataccgcagcaatcaaggatacatcatttacaagttcatttaaatttacagtattatttgcgattgtatcgatcttactgatcaacgtactggcatttggtctggcactgcttctgacacagaagttaaagggaaccaatattttcagaactattttctttatgccgaacctgatcggtggaatcgtacttggatatatctggcagatcctgatcaactgtctgcttacgatcatcggacagccgcttctggcactgaattcttcagccggttactggggacttatcattttgatgtgctggcagcagatcggatatatgatgatcatttacatcgcaggtcttcagaatgtaccggatgatctgatcgaagcagcagagattgacggagcagcaaagtgggatatcctctggaaaatcagagttccgatggtaatgtcttccatcacgatctgcgtcttcctgacacttaccaattcatttaaattgtttgaccagaacctggctcttacaggtggagatccgaaccatgcgacagaaatgctggcactgaatatttaccagacattctacgcacgtgccggaatgcagtggaaaggttatggacaggcaaaagcagtgatcttctgtgttctggttatcattatttcactggtacagctgaaagcaacaagatctaaggaggtgcagcagtaatgaaaaagaagaaaagtattgcaaatacaatatggatagttatattaacaattgcggcactcgcctggatttatccgatcattatgatcctgatgaactctttgaaaaaagaatcagcgatcagtacaggaactgcatttaaacttccgactgcagatgcatttgcaggaatcgcaaactatgtagatgccgttgcttcaaaaggatttttgagcagtcttggatacagtacatttattacgattacttctgtagttgctattcttgtatgttgctccatgtgtgcatggtatataacccgtgtaaatagtccgatttcaaagattttatattatctgtttgtattttccatggttgttcctttccagatggttatgttcaccttgtcacagacagcagataccttacatctgaatatgccatggaatatctgggtgatctatctcggatttggcgcaggtcttgcggtatttatgttctgcggatttgtaaaatcgattcctgtagaaatcgaagaagctgccatgatcgacggatgtaatccgctgcagaccttctttttgatcgatatccatatcctgaagcctaccatgatatccgtaggtattctggaagcaatgtgggtatggaatgattacctgcttccaactcttgtacttgatattaagaagtataaaacaatcccaatgctgatccagtatttccgcggaagttacggaagagttgaaatgggaccgatgatggcaagcattatgcttacagtaatcccaatcatcattgtatatctggcaggacagaagtacatcatcaagggtgttgctgccggagctgtaaagggatagaaaaatatagtataaatttggcggacaggcgttgcttgtccgcttttaaatagaaaaagcttgcaaattttgagagtttccgttaagatatagcgaaaatggtagaaaacattgagaaaggaaagaaggtatgtttcagacgattattggggcggtcagttcatttatgtacagcaaacttctggtgattattctgatcggtgcaggtttatattttacaatccggacaagatttccacaggtgcgtttatttgagagagcttgtgagtccgtgatggagaagccggacgacaaagaggcaatctcatcattccaggcgcttatggtttcaacggcatcgagagtaggaacgggaaatattgtcggggtgtcatcggcaatttgtattgggggatttggttctgtattctggatgtgggtgattgcgatcattggaagtgcgtctgcactgattgaaagtacgctggcacagatttacaagaaaaagggagaggatgggaaatgctatggtggtccggcttattatatcgaggcggcgctgcattgcagaccactggcgatcgtgttttgtattgccatgatcctgacttatgcatttggattcaatatgctggcatcctacaatctgcagtctacattttccggattttctttttatgatccgaaggtaagcccatggatcattggtgggattctggcagttctgaccggatggtgtctgcttggcggtggaagccgtattgtaaaggtgacatcgacgcttgtgccggtgatgggacttgcatatatcggtatggcgctgattgtggttatcatcaatatccgcaatgtgccggaaatgttcctgcgtatttttgaggaagcgtttgatttcaaggcgattttcggagcgtttgcgggttctgctatgatgcagggtatccgccgtgggctttattccaacgaagccggaatcggttcggcaccgaatgcatctgcttctgcaaatgtcagccatccggtcaaacagggactggttcagatgctgtctgtctttatcgacacacttcttctttgcacggcaacggcgatgatgtgtatgtcgtctggcattgatccaaccagggagatgcagggggcaccgtgggttcaggcatctcttcaggaatccctgggagcatttggtccggtatttataacggtggctatggtattttttgcgtttacaacattgcttggaaattgtttctattgcgacaatcttctgacctatatccataaaaaggaaccgggaaaaaaatttatgcgcggattccgcctggtatctgcatttgttgtatttctaggggcaggtatggaaatgtcgcttttgtgggatctttccgatgtactgatgggtgtgatggcactgatcaatattccggtgatcctgattttgtccgggacggcatttaaggcaatccgggattatgaggatcagttgaagcggggagttaatccggtgtttaaaagtgcagatattgagctggagcagaagacggatttctggaattagggaatctgcgagagtggttcggaaaatgatggaaggctgtgaattggatttgacaaaagttgttttgtgataatttggcgtgaaatccggcttgacaaattttgaaggatacggtagtatgacaaaagaagagaaaattacaggctatgaagagaacaagtagcagatgacaaggctcagacagaaagtaaccggttgatgagaggtgcacgaagagtcagatgtgaatacatcttggagtttcacaccgaacgcgcggaagcgcaagtaagctgtgacggagtggcggacgttatacctgctacggtaatgttagttactgactgaggcattcggtgcgagccgaatgtgaattaaggtggtaccacgagagaatatacctcgtccttaaaggctgattggccggaggacgaggtttttttattggaaaaattgaaggggttcaggacggacgctatccggaatctatttctatttgtctgcgggttcggcggctgatacttctaaggttttgtaaatttgttaagggcatgattgaaaatccataactcgcttcgctcagacagatggattttcaatcataacacaaattcccaaaacctaagaagtatgagcatccgccagcacatgcagtcaaatagaaatggtttccggatggctgacatccttgaagacttcaaagagttccagacgggacgcctccttctcctggcggagaagattggctgtgagtaagatataggttttgaaaaagaaaggaaagtagaaaaatgggtatttatgaagagcttaaggccagaggattgattgcgcaggttacggatgagccgcttatccgggatctggtgaataacgggaaggctacgttttatattgggtttgatccgacggcggatagtctgcatgttggacattttatggcattgtgcctgatgaagagactgcaggaggctggcaataagccgattgctttgatcgggggcggtactgctatgatcggggatccgtccggtagaacagatatgcgtcagatgatgacaccggagacaatccagcacaactgtgactgctttaagaagcagatgagccgttttattgatttttcagacgggaaagcactgatggttaataatgcggactggctgatggatctgaattatgtggaagtacttcgtgaagtcggagcacatttctctgtaaatcgtatgctgactgcagaatgctacaaacagcgtatggaaaagggactgagcttccttgagttcaattacatgatcatgcagagctatgatttctatatgttataccagaaatacggctgtaatcttcagtttggcggagatgatcagtggagcaacatgcttggtggtacagagctgatccgtcgtaagcttggtaaggatgcaagtgcgatgacaatcacactgcttctgaattcagaaggaaagaagatgggtaagacacagtctggagctgtatggcttgatccggaaaaaacttctccgtttgaattctaccagtattggagaaatgtggcagatgcagatgttcttaaatgtttacgtatgctgacattccttccgcttgagcagattgatgagatggacaaatgggaaggcgcacagcttaacacagcaaaagaaatccttgcgtttgaactgacaaaactggttcacggcgaagaagaagctacaaaggcacaggaaggcgcacgtgcactgttcagctcaggaaatgcagcagatatgccgacagcagagctttctgatgaagattttgcagacgggtctgtcgatatcctgacactgcttcacaagagtggactggttgcttccaagtcagaagcacgccgtgccgtacagcagggtggagttgccgttgacggagaaaaggtttccgatattgcgacaaaatttgcaaaagcagactttgaaggtgaaggaaaagttgtaagaaaaggaaagaagaatttccgtaaagtaatcgcaaaataagaggacagaaaaatgagttttacagaaataaaagcagaagaattaaaggataatccatttgacctgatcggaaaacagtggatgctgatcacagcaggaaatgaagaaaaatgtaacaccatgacagcaagctggggtggtgttggaattatgtggggcaagccgactgcgacagcttatatccgtgattcccgttataccaaagaatttgtagacagagaagattattttacactggcattctttggagaagagcatagagaagcgttaaatctctgtggaagagtctccggaagggacgaagataagatcaaagaagccggtctgacaccatattatgtagatggaacagttgcgtttgaagaagcaaaaatgatctttgtatgcaagaaggtttatgtacagcgcatgggagaagaaaattttgttgagaaagcaaatcttgacaaatggtatgctgacaaagatatgcataacatgtatatgggagaaattaagaagattcttgtgaaagaggattaggctatgtgtagtaggacacagaagctgactgtagttctggcctctgcatcaccgcgcaggacagaactgctggaacagggaaatataaagcatgtagtcatgccgtcacactgtgaggaagtaattacatcccaggttccaagccaggttgtggaagaactttctgtacagaaagcagaagatgtctatcagcagtatgaaacgaaaaatacaggagattttctggtgatcggctcagatacggtggttgcagcggatggaacgattctcggaaagccaaaggataaagagcaggcatatcagatgatttccatgcttcagggaaaagcacatcaggtttacaccggtgttacgcttctgataaagaaggatgggaaaaagatccggaagacatttcatgaatgcagtgatgtgcatgtatatccgatgagcaaggaagaaatcagggaatatattgcgacaggagagccgatggacaaggcaggagcctatggaatccaaggggcatttggcgtgtatatctgtgggattgaaggtgattataatacgatcgtcggacttcctcttgcaagggtatatcaggaaatgaagaaatatatttattagaaaatgggataaatgaccagaagggagaacgtcagaacagaaaaagagttctgatgttctcctttggttttatttagaaatctgtagagttttaacagatatttagtgtgagttcctgggtgtctaatccttttccggatacttttacagtgacagtgcctggttcatagccggcccggattacggctaaggatttgccatagaatgtcttgaaagtatcgttgcagaagctttcttcaacatttggtcttgcagaaccgtatccctgaagtgttgcaggaccagagatttctattttcagctcctggtcgacagaggattttgtgattccattttcaccgataagatcgatattaaggaagcagagatcctgaccatttgcacagaggtttgttgtttcaggagtgagttttatcgaagtttttccagtggctgagacaagcgtggtgcgggctgtttcttttccggaggagtcgtaagcaatggcttcgattttgccggcttcatatggaattttcctgaattttgcaatatcttttttcggtttctttttacctgcgctttttccattgacaagaagttctattttgtctgcatctgagtagactgttacagaagcttttttcccttcgcagccttcccatgaccagctttccaccgcatctgtgacacgccacatagaaagagactggaaatagtctgtgcgggtataagggtcaacaccaattgttggagttttctgtaatccccagatgatcttgctccatccaacttccggacgtttttttccacagatatcaatgataccggcaccaccggaaataataaggcccggatcggcattttgcttcgtctttttgtctttgtactgaatggtgccaatgcctgattcaccaagataatcatatccggtccacataaagtcgccggtcatggtaggaatcgatttgacaagctgccagttatcgtaaagggtctgcgggagagtttcagagccggttgtcgcctgttccggatgatttctggcatcaattttatagcggctggatgcataattatatccgggaatatcgaaaataccggacataatttcagcaatggcagtcgctttttttgttttggctgctttattgatgagtccgcccattttgttcatcatgatattgaaaaattcagaggtcggagcgttatccagtccaccggaaccactgtctttgactttaccgtcttcgtccgtgccataaatactttttttacttccggccatggtagcaagcatcagattgatcccggctgtgacaggtcttgtatgatctttggtatggcagaattcagtcatgatacgggcctgttcctgcccgtctgcaagtccaagctctgtaatctcgtttccaacagagtacatcacaacagaagaatggttatagtcttttgaaatcatggcagcaatatcagctttccaccatttggaaaatgtttcaccggcgtaatcgtaaggatttttcttgatcagccacatatcaaaagcttcgtcaataatgtacataccaagttgatcgcatgcatccagcattgcctttgaaatgggattgtgtgaagaacggatggcattaaatccggcttcttttaaaatgcgtacccgccgacattccgcatcatggaagccacaggcaccgagtaccccattatcatgatggatgcaggcaccccggaaaaggacggacttgctgtttacaagaaatccatcttttccccaggaaagggtacggattccgaaagaggttctggcagtatcaatggcagttccattttgtagaagggttgccttgcaggtatataaataaggatcttcggcagaccagaggtgtgcatctgggatggtgatggtgacatctgtgccttcggaagatacgattttgccagtgtcattgaaaatttccagtacaattttttcatcaggctgcataaccgcgtcagtaaaaatgtggattgtattaagatcaacaatctgcacttttaacccttccgggcggatataagaacttccggaacggtaaaggtgcacttcgcggtagataccggatccggagtaccaacggctgttcgggacatctgcgttgtctgcaacgactttcagttcatttgttccggcaataacttttccggtgatgtcaacaaaaaagtttgtgtatccgtaaggatgttcggcaacctgtctgccgtttaagaatacggttgcgttttgatagacagcctcaaattctaagatcagagtttgtctggtttcattttccgaaagatcgaaaattttagtgtaaatatatttgccaccggcaaaataggcacttgcacttgcggttttattctcttttgagcgctcttcacggatcatggcgtcatctggaagattgacatgaagtatttcattggatccgtctttctgtacggtccagtcacggttgaaatctgttttttgcataagttttcctcgcttttactattgaatagaacaattcggttaattagtgagtggtaaaaaattttgacatccacatcatatgatattattataaatgatatgaaaaagagtataaatggcataaatgatgggattgaaccttatgtgtatcagattcaattgttaagagctattcgagatgaacaggaatgatcactataaaaagataaaactggtttttatcagaaagaggaataaattatgtattttcaatctacacgtcctatgatgtatcaggatttaattaaagaaatgaaggcatatgaaaaaggttttagagaaaatcattttacagaagatagtctttcttttattttagattcctattatccggaaaaagaagaaggaagagaggtgcttacatttataggaccgaaggatttaggatatctttgtatggacaaggaggaatcggacaaaattcttgaaaggaaaagtatgcacagacataatttctatgagttgatgtatgttgcagatggaaggctatatcagaacattgaaaataccagacatctttatccgaaaggaagttgctgtctgatgaatatgaatattcgccatctggaggaattcgatgagtattgcagagtgatttttctggaatttacacaagaatatattttgaatttactacaatttccaagtgttttttccgggaaacgcacaaaggaatatgagatggtaaggaaattctttttacatgaattggataaagaagaggcatcacaacgggcttatatcgattttattccgatgaaagagacaaaagtagtgcatgattgttttgacaaaattgcagtaggattgcagaagagaacgcctaaatcaaattttcagattgcaggagcaatgataggaatgttatctgcattgtttgacggagcgctttacacaaatacgccggttgctttcggaaatacgtctgagagagaactatttgatcagataaccagttatatccgggaaaaggatggacaggtgcgcagaaaggatttggaggaaaagtttagttattcaggagattatctttataaaacggttgaaaaatataccgggttgtctctgtatgaatatagcacgaaatttacaatggaaaaggcggagggacttcttttggattcggatcttacgattgcagaaatcatggaggaccttggctttagtaatcggacacaattttacaggctttttcgaaaaaattatggaatgactccgagggaatatagaaaatcgaagttccgttaaatgacaggaaatctcaaacgaaattactgtatttactggaacagagattctttgaaaaaatgccagaaccgacagcaagccggaactggcatttgtgctgttaagcaatatcaatcattctcatggcaaaccaaagaggtctgctttggaaaatgtccggagatattatttcagatactgcacactgtacggcggcatctcaagctgtccgctcatctggatttcatttccggtgagcaggtcggtcattgtgcctccgagttctccattgtgcgcagtaaacggtgcgtccgatgcattgatcgcaaccagcatccgttcatcatcggtccgacgctcaaagatgagctgatggttggtcaggacaacattacggtagcttccgtggcagagtgcattgcttccggttctgacgtggatcatttttttgatctcttcggtcagttcatttggctttggttcttcaaagcatggacgaagggcgtagtcattatttggtgcttttaccccttcctcaccccattcacttccataataaatacaaggaacacccggcataccaagaagaagtccgtaagtcagcggcaggtggttcttgttggtcaggatacttgcaattcgggttacatcgtggttgtcaacaaaagacatcagatgttttccgcggtaaatgcaccactgttccggtccgtactgacgattcagagagtgcgcaatctcaaacatgttcatgctgttgaagctggaataaatacctttatagcattcatagttggtgcagctgtgcagcatttcgtcattgacgatctgattgtagtccccgaagagaacctctccgatcagggcaaagtcaggttttaattcctggcagaaactgcgcagacgtttcatgaaattgcggtccaggcagtatgcaacatcaagccggagaccgtcgatgtcaaattcatcgatccagccttttacacattccaggagataatctacaacagcagaattggcaagattcagtttgaccagttcaaaatgtccttcccatccctcataccagaatctgtcattgtagcaggaattaccgtcaaaattgatgcagaaccagtccttgtatggagagtcccatttcttttcctgtacatccttaaatgcccagaagccgcgtcctacgtgattaaacacaccgtcaagaacgatttttacattgtgtgcatggagatctttgcatacttctgcgaaatcttcattggttccgagacggcagtcgatttttttataatccctggtatcataaccatgattgtctgattcgaaaattggatttaataatatagaagagatacctaaggattccagataactgctccagtcctttaattttaaaatccgggatacggttttgccgtcatttgcggtcggagcgccacagaatccaattggatagatctgataaaaaattccttcataagcccacatattctagtacctgccttttagtcaaaatttggataaaaatcccatacatctattgtatcagatagaagcaaatgatggtatactatttaaagcaaaagtggaatttgtaaaaaatgtaatgatatggtaatgtttttgaaaaaaggggaaagggaagccatttttttggttgcaatttatagtaacttttattataatttatggtgcgtgaaaaggtatttgtgcataataatgcacaaatcatggagagaaaaatgtggcagtttatactaggaagtacaggatttattctgtattttatttatgatattaacagtgttcggatgaagaatgcagtattacaaaaattttttgcagctgggagtattctcgttgtagtatcactgattgcagagctttatgcagcatgggggagttgccagcggaagatcggaacaatgaccggatttggattaggaggattccttttcctttgtctgctcatttatacgttgttttttgcgcttccctttgaagaaacctattgtgaagaaaataaactgcgtgcggcttatacggaaggtatgtatggattgtgccgccatcctggtgttttatggtttgcaggagcatatttgtgcatgtggggaatggtcggtggatggaaacatgggatttattttttacttatgattttctggaattatctgtatattatttttcaggatctgtggacattcccacggacattttttaactataaagaatatcagcaaagtacaccgtttctgataccgaacagaaaaagtatacgggtgtgcctgcgtactatcagaaaaaatgattgatctggagcggacagtctatgaatttaaaagaaaaattaaaaaaacaacagtataatgaaatatggcagcagtactgtggatttctggatctgtcgatggacggttacatgaaaatccagcggcggctgatggaagaacagatccagctgtggagtaactgtggacttggacagtcgattttgaaaggaaaacatccccgaaatctggatgaattccgcaaaatggtaccgctgacggagtatgaagattatgcagacattcttctgaccaagcagcctgatatgcttccggggaatccggtgatctggattcagacaacctgggaaggcgggaaacatccgattaaggttgcaccgtatacaagaagtatgctggatacctaccggaataatgtgacagcatgtctgattttatcgaccagcaggaaaaagggttcttttgatgttgcatctacggacaaatttctgtatgcgctggcaccgcttccgtatgctaccggactttttccactggcactcggggaagaaatcgatattgagttccttccggcagtaaaagatgctgtgaatatgagtttcagcgaacgaaacaagctgggatttaaaatggcgatgaaaaaagatctgggatttttctttggtcttggaagtgtggcttatgcggtaagtctgagcctttcttcgatgaccggtggcggcggtatccaactatcaagtcttctgaaatgcagaccgcatatgatcttccgtatgatacaggcaaaataccgctgcaaaaaggagaaccggcaattactcccaaaggatttattccatttgaaagggttcatggtagcaggtacggacaatcagtgctataaagatgatctggaagaactctggggaatccggccgatggaattgtttgccggtacggaaccatctataatggggacagagacctggacgagaaaaggaatgtatttcttcccggatacggcattttatgaatttatcacagagaaggacatgttgaaaaatcatgaggatccgtcttatgttccaccgacatatctgatggatgaagtccagccgggagaaaaatatgagctcgtatttacgattttgaaaggcggtgcattcgcgagatatcgctgtggtgatatgtatcggtgcgttggactggaaaacagggaagatgaaacacagatcccacgttttgaatatgtggaccgggtaccatggatcattgatatagcaggatttacaaggatttcagaaaatgggatccgaaatgtcattcgtctgtcaaagctcccgatcacaaactgggttgcggcaaaggaatataatgaacagaaccgcccatatctgcatatgtatgtagaactggaacgggaatccttgctgaacagtgccatgagcgccgatattttaaaagagttactgagtacatattttaaatatattgatcaggattaccgtgacttgaagaaaatcctgggaatggatcctttacaggttacaatttttacgtgcggaacatttgaaacttatgaaaaaaagactgggaaaaaactgcatcagatgaatccttcttattatgatttgaaggcgttgctggaagtgcaggaatgtttgaacaaagtgagataagagggaattatgggaacctatggatatatttcaatcatagcaatggtgtgctatggatttatgctgctgatgtttctgacagcgaagcgaaataaaattgtaaatagctttctggtagtgctggttggactgcttttttgggctggaggatcggcatttatgcgtgtccatctgtggccaagttatgaattctggtatcaggtttccctgcttggaattttactgctgccgtatgcatattattgttttattctggcatttggcggagtgaaaaaaagtctgccagggaaaatatatctggctgttatgctgatctgttttgtggtaaatatccggcatggggtattcctgggatgcccgaatgtggtggaaaagaatgggcttcctacttttgtgtatgagattaaacctactatattagtactctttttcccggctgggatttttttgatttatcttttccttatccttgtgcggatctgcaaagcgaatcccaatatgaaagtacagtatgaaccggtcatggcaggggttctggtgttgtttgcagggaatatgttgcttggaataccattcttcagtggatttccgattgatattttaagtggcgttgtaaatgtattttttctgttttatgcactgatacgcagacgtctgttccggttgcagatgctggcatcgcccagtctgtgttacggtgtaggattcttgttttctgttattgtatttttgaatgtaattccatatctgcagaaaatcttccatatacagatggataagaatacaacgctttatgcccttgtttttgcaattgtgtttctggtgatttatgcgctgtttacttttttgtggaagcttctggtacgcagtgtgtttgtcagggaagaaaattatcagacagaaaaaatcagggagttcagctctgcaatttcgaagacgctggatttaaatgaaattctggacaaaacgatcagtgtcatgaaagaactgatggatgttggaaatatctatatttgtatgcaggatgcaccgggacagccatatcggggagtggcaagtgatcagccactgaatgatctgacatttacgatggaagaagaaaacccgatgatccagtggctgaaagaacatgaagagccgatcatttaccgggatttccgttataccgtggagtataagtcgatgtgggagagtgaaaaacaccggctggataagacgcatatccgttactgtgcagggttgaaagatggagaatgcctggttggtgtgattctgatcacagatgcttcggtgaaaaaacggctggtatatgatgaggtgcagctgatctcatctgttacgtcggttgcatcgattgcgattaagaattcaagattgtacgagagagcccgccaggaagccagaacagatgagatgaccggattactgaaccggaaatatttctatgaagtgctgaatgaagagcttgagaaaaacagggaggcatcgctggcacttgcgatcatcaatgtagatgattttaaattgtataatcagttgtatggggtgaaagaaggagatctgtgtctgcagcggattgcagatattatcagaagcagtgtcggagaaagtggatacacggcccgctatggaggaaaggaatttgcggttcttttaccgggatatgatcttttttccgccagaaatatggtggaatctattgcaaaacagatttatgttatgaataaccgcagaacggatatgaagctgaaagcggtaactgtgagtgccggtatcagtgcggctccttatgcggcaaggaacgtgaaagagctgatggaaaatgtagatctggcagtttatcatgtgaaacataatggaaaaaatgggatccaggtctttgatatgatgtttcggaacaacagtgaggggaacaatacaaggaatcacacccatatttatcaggagtatgagtctacgatttatgcgctgacggcggcaattgatgcgaaggatcactatacgttcagccattccaacaacgtagcttattatgcaacgtcactggcgacgacccttggaatgaacgaagatatgatagagattatccggcaggcagcacttctgcatgatgtcggtaaaatcggtattccggagtatatactcaataaagagggaaaactgacagatgaagaatatgagatcatcaaagggcatgtagaggcatcgatcgatattatccgtcaccttccatcgctggattatgtaattccggcagtcatcggtcatcatgagcggtatgatggaaaaggatatccacgccggatcgcaggagaagatattccactgactgcgcggattttgtgcgtggcagattcttttgatgccatgacatccaaacgatgttataaaaaagcattttctattgaagtggcacgggagaagcttcttcaggatgcaggcagacagtttgatcctgacctggtatataagtttgttgaatgcctggataatggcagtattacactggtgaaggcagaagaaactgtggacaatctgaaagaaatactgtagaaaattcccacaaaaaagtgatgaaaatcagcaagaaacagttgacaaaagcctgctggtataatataatatgcaagtatgacgtgagaagaaacagtttgcaccaaagccccggagtgaacttgttttctatagaatctacaatgaaaataattagtaaactgaaattcataggaggtcaaccaatgaaaacttacatggctaatccagataagattgaaagaaaatggtatgtagttgacgctgaaggacagacacttggacgtcttgcagcagaagtcgctaaagttttaagaggaaaaaataaaccggaatttacaccgcacattgatacaggtgacaacgtaattgttatcaacgctgaaaagatcaaagttacaggaaagaaattagatcagaaagtatactatcatcactcagattatgtaggaggaatgaaagaaactacattaagagaaatgatggcaaagaaaccggaacaggttatcgaacttgctgttaaaggtatgcttccaaaaggacctttgggaagaacaatgatcaagaaacttcacgtatatgctggagcagaacatgctcatcaggcacagaaaccagaagttttaacattttagtcagaggtttgaaaggaggaaataaaagtggcaacagctaaattctacggaacaggaagaagaaaaaaatctatcgcaagagtataccttgtaccaggtacaggtaagatcacaatcaataaaagagatatcgacgaatatttaggacttgaaactcttaaagttgtagttcgtcagccattagttgcaactgaaacagttgataaatttgacgttctcgttaacgtacgtggtggtggatacacaggacaggcaggagcaatccgtcacggaatcgcaagagcacttcttgaagcagattctgattacagaccggtacttaagaaagccggataccttacacgtgacccacgtatgaaagaacgtaagaagtatggtctcaaggctgcacgtcgtgcaccgcagttcagcaagagataatctgctgttcaaaccgtatcaaaatggttcaaaaaccccggaaaatcaaggttttccggggttttactgtatctaaacgggctgatatggtttgaccaaatttggcaaaatgagagccgttttcacccgatttttagtggtccgcaagtggttaaccggccaaaaagagggcaaaaagagggtcaagtggtgcccaaagtggttaaccgagagcctattttgggggcgtttttgggggtacttttcagccctgcttcccctcgttttggtctgtggaagtttggcatagtttgatctaatttgaataattgaatatgaatttgatgtagcactcagtataaaatgactgggtgcttttttcatttcaggaatttgtattccggcgatagaaagagccgtcacttcagttttcattttggagtggcggctttttctatttccagaagcaacagcaataatcagaaatgaggtgaagtcaatgaacacgcaaatcatcgccatcgccaaccagaagggcggcgttggcaaaaccaccacctgtgccaatcttggaatcggcttggcgcaggccggaaagaaagtcctgctgatcgacggagacccacagggaagtctgacgatcagcttgggcaatccccagccagacaagctgccctttacgctgtcggacgctatggggcgtatcctgatggacgagccacttcgtcccggcgagggtatcctgcaccacccagagggtgtagatctgatgcctgcggacatccagctatctggtatggaagtatccctggtaaatgccatgagccgtgagaccatcttacggcaatatctggacacgctgaagggacaatactcccatattctcatcgactgccagccctctctgggtatgcttacggtcaatgcgctggccgctgcgaacaggatcatcattcccgttcaggcggagtacctgcccgccaaaggactggaacagctgctctctacggtaaacaaggtaaagcggcagatcaatcccaagctccagatagacggtatcctgctgacgatggtggacagccgaaccaactttgccaaagagatctccgcgctcctgcgggagacctatggcagtaagatcaaggtattcggcacagagatcccccattctgtccgggcaaaggaaatcagcgccgagggaaaaagcatttttgcccatgctcccagtggcaaggtggcagagggctacaaaaatctgacgaaggaggtgttgaaacttgaaaagcagcgcgaaaaaaatagagctggcctcggtagatgatctgttttccaccgaagaaggccgccaggatgcaaagctggaaaagattcaggaaattcccttgtccgaactgcatccttttaagaaccacccattcaaagtcaaggatgacgaagccatgatggagaccgccgacagtatcaagcagtatggtgttctggtcccggcgattgcccgaccggacccagagggcggctatgaactggtagccggacacagacggcacagagccagtgagctggcagaaaaggagaccatgccggtcattgttcgggatttggatgatgatgccgccacgatcattatggttgacagcaacttacagcgtgaaagcctgctccccagcgaaagagcctttgcttataaaatgaagctggaggccattaagcaccaaggagccaggacggatttaacttcggcccaagttgggccgaagttgactgcggcagaaaaaattgcggagaacagtccagatagcaaatcacagattaagagatttatccgtctgacagagctgattcctgaattgatggatatggtggatgacaagaagattgccctgaacccagcctatgagctgtcctttctcaaaaaagaagaacagacagatctgctggacgccatggacagcgaacaggctaccccctccctttcccaagctcagcggctcaagaaatacagtcaggaggggcatttgacccttgatatgatgcgtgtcatcatgggagaggaaaagaaaagcgatctggaccgagtgacatttacctctgacaccttgcggaagtattttcctaaaagctatacgccccagcggatgcaggaaactattatcaagctgttggaggcatggcagaaaaagcgtcagagagaccaggaacgatgaaaggagccgcctatgagggatatttcagcccgtgagctgaaaggacacaatattctcgccgtagagaggttttgggataacacccgctggatgattgagttttctgtcctgtgttccaacaccgtttatggcagacccggagatgaaatgcgtctgtttttgactgaggacgggtatcaggccgccctgcaaagccagcagcgccgggagatcaagatcaagcgttacgctcgtgtgatcgaggggcatatcctcgatttcaaaccgggaaaacgccaccgctcataaacccatacaacgaaaggaaaggaatgactatgtgtacggtaaaggaaattcaggaagcaatccgggaagattgcagatcccagcatgacatggattcaacggatattgaccgcgtgatgcaaacacttcctttcgcccaggaggaaccatttacaggggcgcgtccccaaaagccgctgttttggttttatgcgagaaaatttgaaaagcgttgaaaaccgcaattctttgaaatgaggattgcggtttttttgtacccaaaattcggaaggagtgaggccgatggccgtttttcgcattgaacggacccgtgattataccgtgatgagcaatcatcatttacgaaatgcaaacctgtcgttaaaagccaaggggctgctttccatgatgctgtctttgccggaggactggaattacaccacccgtggccttgcaaagatctgtaaggaaggcgtagatgctatcggtgctgccctgcgtgaactggaaggagccggatatatcgtgcgccatcagagacgcgataaaagtgggcggatcacagataccgagtatgtcatctatgaacagccccagccggatctgtcccagccggatacggcttcaccagatacggaaaacccggatatggtaaaaccggatacggaaaagcccgcagaattaaatatagagaaatcaaatacagaaaaatcaattacttatggatcaagtaccgattccattcccttccgggagccagcggcggcaagaccgccggaacggaaaggaagggatgcgatgtctgtcacagagatagagaattatcgggatttgattttagagaacatcgagtatgactacctgtgcagggagtttgccacctatcgggaggatttagacgagatcgtggagctgatggtggaaacagtctgtgccagacgcaaaaccacccgtatcgctggcagcgactttccccatgaggtggtgcgctcccgttttttgaagctggacagcgaacatatccggtttgtcatggacagcttgcagaaaaacaccaccgaggtccgcaacatgaagcagtacctactgacagtgctgtttaacgcacccaccaccatcagcaaccactacacttcacaggtcaatcacgatatgaacgcaggcggctggtaaggccgccttttatcatgccaaaggaggcacgacatgaaccagatggaaattttcaaaaacccggagtttggcagtatccgtgtcattgaggaaaatggcaaatatttgttcagcggaacggatgtggccgctgcgctggggtacagcaatccccgcgatgcaattatccgccattgtaggtatgtcgtgaaacgcgacgcacctcacccacaaagccccgaccgcaaaatcagtatgacttttatcccagaaggcgatttgtaccgcctgatcgttcacagcaaattgccatcggcagagcagtttgaacggtgggtattcgatgaggtcctgcctacgattcgtaagcacggggcttatctcacaaaagagaagctgtgggagattgccacttccccggaagcactgatgaagctctgctcagatttgttggctgagcgtgaagcaaatatttctctgcgtaaggaaaatgcacagctggagggcaaagccgctttctatgacctgttcatcgacttaaagcacagcaccaatctcagaactaccgccaaagagttggatgtcccggagcgccggtttgtccggtttctgatagaacggcgttttgtgtaccgcacggcatccggcaatgtgctgccttatgctaatgtgaaaaatacagggttgttttgcgtcaaagactactgcaaccacggtcataccggttcctacacgctggtcacgccccaaggcaagctctattttgcccggctgcgggagatgatcttgctggtctcataagaaaggaagtgggttttatgcaggaaggcaaaacgatcggtcagctgatggaggaaatgcgccagaaagccggggcgcagaactaccacggccatgactacatggatctccagcgatttgcggagaacacccggcacatgattatttttgatgtgctgacgaacgattcccctgttggctggaaaggcgaacgaacccgcctgttcttgtcggatactggttatgaaaaagcgttggatagtcaggcaaaagggcagatcaagattctaagccatgcaaaggtcagaaatggagatttgttttatgaccacaaagaacagatacgataggaggaatccaatatgaatgaggaaaagacagtaccctttaagtgggaatatggggaagaaaccatatcgctgcaacttgggatgtatgcgaataatcagcggctttatatcagcatgattacccatacagaagatggggcagaaccgtttgccgatatgacagtgaaccttccggggtattccctggaccccggagaggcgtttatttccggtgacatcagcaaggacctactgagattcatcaaagagaacaaattggggaaggtgcttccctatcaggtgcagtccggttatgggaaatattctgcggttgcctttgatctggagaagttgaaggcatttgaccctaaaggcgtggcagagtttcggaaagagtggaatctgccggataaaaagccagtaaagaaaaagagccgcgggatggagcgatgaagaaatattttctccggcggctggtggtcccgccttagaaagaaatgcaccacccctgcacattttgtggaaaggaggagatgaaaatgcaggaagaagtggaaaacagaactttgacgctggttgtcagtggaacaaagtttaccggcagaatgtttaaggctgccataagcaagtacatggcacatcgcaaggaaaagaaactgcaaaagcagagaagccgtgatgcgccggttattccgcacggaaaacagactgtgaagcagcttgtcgggcagaatcagggaatatccaatattgagatcacagacccctctatcaaggagtttgagaaaatcgcccggaaatatggtgtggattatgcggtgaaaaaggatcgtagcagttctccgccaaagtacctgattttcttcaagggtcgcgatgcggatgcgctgacagcagcctttacagagtacaccaataaaaaggtcaaaaaggcaacgaaaacagagcgcccgtctgtactggcaaaacttaaccagttcaaagagatggttaaaaatgccgtggtggaccgcaccaagcgaaaggagctggaacgatgaaaaagacattggacatcaaaaagctcgttttgctgaatatgccgtatatcctgctggggctgtttgctaccaattttggagaggcatggcgaatggcacaaggggcggatgcttcagagaaattcctttccctggttgcggttctgcctgggacgctgcaaagtttctggcccagcctgcacccgttggatctgctggtggggctgtgttgcggtgccggcctgcgtctggcggtgtatcttaaaagcaagaacgccaagaaatatcgacatggtttggaatatggttcggcacgatggggaacccgtgaggatattgcaccttacattgatcctgtatttcagaacaatgtgattctgacgaaaacggagagcctgaccatgaacagccgccccaaggacccaaagaccgccagaaacaaaaatgtgctggtgatcggcggctccggttccggtaagacccgcttctggctcaaaccgaatttgatgcagatgcacagttcctatgtggtcacagacccgaagggaaccattttggtggagtgcggaaaaatgctccaaaggggcgcacccaaactggctaaagacggaaagcccatgaaggataagcacggcaaggtcatttatgaaccttaccgaatcaaggtcctaaataccatcaacttcaagaagtccatgcactataacccctttgcatatatccactccgaaaaggacattttgaagctggtaacaacgctgatcgccaataccaaaggcgaaggcaaggccggggacgatttctgggtcaaagcagagaccttgttgtattgtgcgctgattgggtatatccactatgaggccccggtggaggagcaaaacttctccaccctcatcgagttcatcaacgccatggaggttcgggaggatgacgaggagttcaaaaaccccgtggacctgatgtttgatgcactggaagccgagaagccaaatcactttgcggtgcgccagtataagaaatataagctggccgccggtgttgtatgctctaaaagacttcttaatcaagcggttgggaagtctcttagaacacacaacctaaaaccgaagaaaggagcgcaagttatgagaaaaagcgagaaaatcacagctttgtacgaacgattgagccgtgatgactttggcaaagatgatgaccagcagcgtgagagcaactccatatccaatcaaaaagcaatgttggaggacttcgccgcacggcagggctttacaaacattgtccatttcacggacgatggcattagtggtacttgttttgaccgtcccggatttttggcaatgatgaaagaagtggaagccgggaatgtggagtacctttgtatcaaggacatgagccgcatgggtcgtgactatctgaaagtcggtcagattatggaaatcctgcgtcagcgtggcgttcgccttatcgccatcaatgacggcgtggatagcgccagaggggacgatgattttacccctttccgcaacattatgaacgagtattacgccagagacaccagccgtaaaatccgttccactttccagtcaaaaggcaagtccggcaagcacctcacaggcacggtcatttacggctatctctggaacgaagccagagaccaatggttggttgaccccgaagccgctgatgtggtcaagcgcatctttgccatgacgattgacggctacggtccgtatcagatcgccagcaaactgaaatcggaaaaggtgcttattccgtctgcttaccttgcccaacacggcgagggcgtgaacaaaaacaagactttcaaagatgtgtacggctggggttcttccaccatctgcaacattcttgaaaagcgtgaatatctgggacacaccatcaatttcaagacccgaaagcacttcaaggacaagaaaagccattatgtcccggaggacgaatggacaattttcgagaatacccatgagcctatcattgaccagcagacctttgaccttgtgcagaaaatccgtgggaatgtcagacgctacccggacggctggggcgaagcagctcccctcacaggcttgctttattgtgccgattgcggcggcaagatgtatgtccaccgtaccaacaacggcaagcgtatttctcaatatacctgttcccaatacagcaaagtcccagttggcaagctctgcacgacacagcaccgtatcaatgaagatgtggtactgtcccttgtctctgaaatgctgaaagccattgccgagtatgccaagcatgaccgagccgagtttgtccgtgtggtgcaggaagcgcagtccagccagcagacaacagaggtcaggaaacagcgtacacgccttgccacagcaaagcagagagtttccgagctggaagtcctgctctgcaaaatctatgaggacaacattttaggcaagctgtccgacagcagatacgccactctggacgctcaatacgaaaaggaacagtccgagcttaccgctgaaatctctgttctggaaaaggctgtcaagagctatgagaagcacgaaaaggacgctgatcgttttatcgctctgattgacaagtatgagaacttcgacaagctgaccattgctatgctcaacgagtttatcgagaaaatccttgtgcatgagcgtgaccgtaaaggcagtatacagaccacacaggaggtcgagatttacttcaattttgttgggcgattcgttcccccggcgtttggagaagcggagcttaccccggaggaattagaggaaatccgcaagcgtgaggaacgcaaggacaggcttcatcagaactacttgaagcgtaaagccagcggagcgcagaagcgatacgaggacaaaatcaagaggagaaaaaaagcagaaatcgaagccaagaaagccgccattcgtgcggaggatattgcaaagggcgtgttcgtccctgtcaacagtttaccgcagagagagccgatgaaaggagtacaaacagcatgaatatcgcttacacacagaacggagattatcttatcccgaacatcgttatccgcaagaccaagcccctcggacactacggcagacttcgcaaggcgtatctgaaaatgcaccgtccgatactgttcaatgagctggtactatccgacaagctctttgagcattgcgccgagattgacgaagcggcacgaaaccgcatggagctgatcgtgcggtcactggcagagcaaaacggcgtgaccgagcaactgaaagctgaaaaccaaatggaatgggtgcggcagatgaacgcttgcaaggcgcaggcagaggaagttgtgaaagcagagttgatttataattgagcgaggaagtccgggcagaaaactgttcggacttttctcatatagtccaaagttgcggtagaattgttcacaagttttatggtataatttgaatacgaaattgagcaacaaatcggaagttcaatgtgaggaaaattagatgaagaaaaagtcttattggttaagtattagtgtgttcgtattgatactgatatggacggtttattattatgcaatgcagtacacaggaggatttgcagacttaaaggactctattgtttgtgggattgcaggtttgatatgtatcgtatttatcgtgaaaagaactattgactttttgaaaaacaaaaaatcgtaaaatttcagtttgtcgcactgataaaacccctttaggaactaaagggcgcacttctatactctctgtcgagagtagtgcgtcctgcggagcttcattctccgtcagcagaagaaaactgcatgaccgagaatgttgcgtcacttcgttccgtcaaggtggctacacccccttgcgccgctaaagcggctatcccctgtggacttgccgtccgcaaacggttttgacaaaccgttcgccgccagcaagtttgaaaatcaagaatcttaatttgataaaggagtgtgattctatgaaaaagaaattacccataatcctcttgggtgttattttggcttgtgtgttggttttcggtttcctttatgcaaacaatgacattggtaaaaccgcaaacagtttagaagcagacattcgccaatctcaaaaaattttggatgattggattgttgatggaagcatttccgacacaatggctgcatttatttcttacccacaggacaagacagaccacactttttctgtctatgtaaatcgccctggcttgtcttttggatatttcttccgtggtggtggagatatagttgaggttgatgattacattgcagagtttgttgttgagggaaataacgaaagggcatttatctcaatgaatacccaaaatattgttcgacttgaagtagatgatggcaacggcattcaggtgattgatattgatagtggcaagcctttcgccattgtcctgcccctcaatgtaggaaacatctgtttctatgatacgaatggaaatgttgtggaatatcttcgccaacaactttgaccaacttcaatttaccgaactgaacacaacaactgaataccgaaaaactgaccgttgactggtcgcactatgcgaaaagttgacggtcttttttatctccaaaatcaaaaaaggaggtcaatcacaatgacaaaactgaaaactctcgaccagctccgaaccgaaaaggaacgagccgagacgcagcttgcacaggaacagcacaagttggagcgtctggagaatagaaagaagtatctggagaaaggtgaacgcaccaagcgcacccaccgcctttgcaatctgggcggcacgattgagagccttgccccggaggtcaaagatctcacacgcaccgaaatgacagagctgatggaacacatcttttccctgtccgaagtccagcgagccgtccgtcacatggcgattacccacatcagccaagcaaacagagaaaaggagttgaaagccgatggcactatttcatctgagcgtcacgcagactaagcgaagcgcaggacagtccgctatcgcttctgctgcctaccgagccggggagcgattgtatagcgagtattacggcgaatacagcgactacacccgcaagggcggcgtgatctgctctgacattctcttgccgtcccatgcaccgccagaatacgcagaccgccagaccctatggaacgccgtggaaaaagccgagcgtggaaagaacgcccagcttgcatacagctttgacattgccttgcagaatgaattttcccttgaggaaaacatcgctcttgcaaggcaatttttgttggagaactttgtgagccggggcatggtggttgacttcgccgtacaccagccagacagggaggacggcggcataccaaacccacacttccatgtgctttgccctatccgtcccattaagcaggacggcaaatgggggctaaagcaacgccgggtgtacgagctggacgaggacggcaaccgtatccgagaccagaacggcgagtttattttcaacgccgttcccactaccgactggggcagtcccgaaacgctggaatactggcggcagacatgggcggagctatgcaacgccaagtttgcggaaaaggggcttgacgttcgtatcgaccaccgaagctatgagcgtcagggcgtggagcttcttcccaccgttcatgagggcgcaaccgtccgggcaatggagaagaaaggcatacgcaccgagaaaggcgagttcaaccgctggatcagagcgaccaatgccgttatccgggacatcaagaagaaaatcgctctcctgtttgattggattgccgaagcaaaagcggagcttgccaagccgcaggcaccaaaccttgtttctctgctgaacgcctattacaccagccgcagagccggggcttattcgcagaaaggcaaggtcagcaacctaaaggagatgaacgaaactttcaattatctccgggcaaacggcatttattcccttgaagatttggaacaccgtgtcagcgaacacagtgctgccacagagagcttgaagaaaacgctggacgaacagaccgcccgaatgaaagcaattaagcagctctatgacagctccgctgctttccagagcttgaagcctgtctatgacggcttgcagaaaatcaagtttgagaagcccagagccaagtacaaggcagagcatgaaacggaactgaaacagttctacgccgccagacgaaagctgaccggggagttcccggacggcaaggtggatatgaaaaagctgtccgacgagtatgacgagctggaacaggcgcacgaaaccacctatggcgagtttaaggctgtcagagacgatttacaccgcctttggaaggtcaagtcatgcgtagatactgccgcccgatttaacgagcgtacagaggaacaaaagctccaaaatcgaccccaaacacgacagaaaaaggaggaactatcccgatgaattacacccaagcacagattgaccgggcaaacgccgtcagtctggaagattttctccgcacacagggagagacacttatcaaaagcggacgggaataccgttggaaagaacatgacagcctgaccgtccggggaaacaagtggtttcgccacagccagagcaagggcggctatcccattgatttcgtcatggagttttacggcaagtcctttcccgaagctgttcagatgttgacaggcgaaaacggcgagggacagaccgaagccaccacagcaccgcccacagcgttccacttgcccttgcacaacagaacagccgacagagcaattcaatatctttgcgaaagccgaggtctcaacaaaacgcttgttgagacttttcttctttccggggatatttacgaggacgcaaagcggcacaatgttgtgtttgtcggcagagaccgaagcggtacgccgagatacgcccatgtgcgaggaacggcagacccattcagacaggacattgccgggtctgacaagtcctatccgttccgctatgagggaaacggcaatcagctctttgtctttgaagcaccgatagaccttttgtcctttatctgcctttacccgcaggactggaaaaatcgaagctatcttgccctgggcggcgtttcgggcaaagcccttgaccgtttcctttctgaacgcaaggacacccgaaaagtgttcctctgccttgacagcgacaccgcaggaagcgatgcctgtacccgactggcacagtccattcccggcgagatcgccgtcattcgccttgtcccggcaaggaaagactggaacgatgttctccgtcagcaaggggacattcccagccgcaaattcatagccgagacaatcacgctgcgagagctgcccaccgcccagcctgtccccatgctccgcatggcagatgtggagctgacgagcgtggattggctatggtttccgtatatcccctttggaaagctgacgatcatacagggcaaccccggcgagggcaagacctactttgctatgcgccttgcggcggcttgcaccaatcgaaagcctttacccggtatggagacccttgagcctttcaacatcatctaccagaccgcagaggacggtctgggcgataccgtcaagccccgactgatggaagcggaagcagaccttgaaagagtgcttgtcattgatgacagggatacgccgctgacccttgccgatgaacgcatagcaagggcaatccgggaaaacaacgcaaggctggttatcattgacccggtacaggcgtttctgggcgcagatgtggacatgaacagggcaaacgaggtgcgcccgatattccgcagtctgggagacattgcacaggctaccgggtgcgctatcgtgctgatcggacacctgaacaaagccgcaggaacgcaaagcacctaccggggattggggtctatcgacattacggcggcagtccgcagtctgctttttattggcaagctgaaggacagccccacaacgagggtgcttatccatgagaaaagctcccttgcgccgcccggacagtcccttgccttttctctgggagacgagaaaggttttgagtggataggagcttatgacattaccgctgacgagcttcttgccgggacagacaccgccaagaccgagagcaagaccgcacaggcgcaaatgctcattctggaactgcttgcagatggaaagcgtatgccgagcgcagagctggaaaagacggtcaatgagcgtgggatttcctcacgcaccatgagaacggcaaagagccgtatcggggacagacttgtgaccgagaaagacggcacagcatgggtctgctatctccgcaactgacaacaggaacacggcaagcgtggcaaagacggcaaggtttttatagataccttaatgttgccgccttgccttgttccctcataccgacgccgcccgatgatgaacagtcaccgggcatttttcatttacaggaggattttgaatgaacaataccgcaaccaacaccgccacttgcccgactgtcagaaagcagattggcaagaccacctatatcgtccgtgtccatttcagcgagaccgccaaggagacgatggaggacaaaatcaagcgtatgctccgtgaagaagtccgcagaatgtaacttatttttgaatttgatgaaaaagtccttgacaatttgtctctggaaaaacagccaagtcgattttgatttcctgcggtgcgcgtctggccgtatttgatattgcggagctgcgcgaggttacatcctacgatgagttggaactggatacgctgggagacagaaaaacggctctgttcctcattatgagtgatacggatgacagttttaactttctcatttccatgtgctacacccagttattcaacctgctttgtgaaaaggccgacgatgtgtatggcggcaggcttccggttcatgtgcgctgtttgattgatgagtgtgccaacatcgggcagattccgaagctggaaaagctggtggccaccatccgaagccgtgaaatctctgcctgtctggtgttgcaggcacagagccagctcaaggcaatttacaaagataatgccgataccatcatcggcaatatggatacttccatcttcctgggtggcaaagagccaacaacgctgaaagagctggcggctgttctgggaaaggagaccatagacacttacaacaccggagagagccggggacgggagacctcccactcgctcaactatcagaaattgggaaaagagctgatgagccaggacgagctggcagttatggatggcggcaagtgcatcttgcagttgcgcggtgtgcgtccgtttctttcagacaagtatgacattaccagacaccctaatttcaaatacacagctgatgcagacaagcgaaatacctttgatattgaagcatttttgtctgccagactaaaactcaagccggatgaggtctgcgatgtatatgaagtagacacggagggcgtgtaatacggttccgctgagaaaggagtgatcgtatctatttgccgcaactgcctctgttgaggccattggcgtacaaagcgggcaatcatcaacaaaataatgaaaaaggaggacagccggaatcaggctctcatatatcgagggcagattgttccggcttttgtatgcctatgaaacatgacaaacctattttttaatcagattccggctaacaaactatatggcattttttgaacaggcaattaccgttcttcagactctcgttatcgctctgggcgctggtcttggtatctggggtgtcatcaacctgttggaaggttacggcaacgacaaccctggcgcaaaatctcagggcatgaagcacttaatgtcttctatgtgaaaagattttaaaggaaaaacgcacatcctacgcagataacatgacaatttcatgcaaagcgaaaggagacaccatgaaaatcgaatacacaaaagttagagactattatttaccgaatctttactacccggaggaaaccagaccgattggcttctggggaatgcttcggaaggaatatctgaaagaacataaatctggaacttatacatatcttcttctgactaccagactggacagctatctggcagatctgaatgaacaggcacaggaacgctttgagctgatcgaagcgcaaatgagaagttcagagggagttaccgaggaactgaagagacagaatcctatggaatgggtacgccactgcaacaatatccgcaatcgggctgctgaaatcatcaagcaggaactgatttatgtataagggggattccagatatgagaagagaattgattgaaagctattatgaagaataccaacgggaactggaacgatttcttgaatctgatccggagatgttttctctggaagcagaaattcattattacatagaaatactggaaccagtcctcagagatgccggacaggagatgtggcaggcattggacagaattatctcagcgaagaatgccatggaaggacatgtggcaaaagaaatgtatatccgtggatttctggactatgaaagacttgtgtgtgaaaaggacagtaacatttgaatagtcatcttacaagcactgactgtaatggtcggtgcttcttttttgattttttgaaaaataatctgacattcttcaagtccccacgtgtgattagtagaaaaaataaatttttctgcgaaagtaccgtccaaacgccctctgaaacttgctattagtgagggaatatttcatttatgcgaaaaaaacttgcaaaagggggttggtaaataccatttccaacgctttataggtagaggaataattatttttcaaaaatctccaaaatcatgtccgcttttgcttgtcccagtacagagtatgtgaagggactaatgaaaataaaagaaaaactgataaaaatgcaaaaaaatatcacgaattttttgcattctgacaagtcatttgactttagtaatcagaggacgttttggaatgttccttcgctgaaccttgacaaccgataagtgcaccctggaagcctaacaggagttctgccatgacctttctttttctgagagcaagcggaagcataatgacactcccgatgatgggcggctgaccggagccttatggtcagtgacctgcttatgcaggcagaggcagtctgagacggctgcaggtgacagggaaacgcacgccagaccaccagacgaatgaaactgatgacaatgtttacagggcaaaatgcccggaaaggagcagtttatgacagaactgaaaataaaagaaatgcagctgatcaactggtttggatgcccaaatctgatttatacaagggagagaatccatctggctgccatgcttgctacggatgaagaaatgaaaaagaatctttacagagtatgcagatttcttgcaagagaagaaatcgcatatcggtatccgatcatgtatgaaatgatccggaaaatgttttcaccggacgataccaatccaccggaagcatgtgcaatgtttatgccggataataaaactgatgatgaatatgcaatggcagcgtagctgcggaaaggacggtaacgattatgaataaagtaattttaatgggaagactgactaagaacccggagattaaatatgccgggaaagacaatgacatggcagtggcgagatacacactggcggtaaacagaagatataaacgtgacggtgaacaggaagcggattttatttcttgtgtcacatttggaaagagtgcagagtttgcacagaaatatcttcataagggaatgaggattgtaattggtggtcgtatcagcaccggtaattataaggataaagacgggaagacaatttataccacagatgtgattgtggaagaacatgaatttgcccagaacaaggataacggtatcggagcggattcgtcggaaacatcaaaaacagataaggacggattcatggaagcaccagatggtgagattccatttgactaattcagagtaaatgattggagaggttgccctttgccggggcatcctcttttccattttactgaagatatcaaaaattacaggtattcaacctaacgaaatcgtgatataatataaaatatgtttgaatgagaaatatggaggtagcttatgggcgtaagttataacagattatggaaaatgctcatagataaaaatatgaagcggatagagatgcagtacctcaccgggataagtggaaacattcttgcccggatgggaaaaaaccagtatgtatcaatggagacgattgagaaaatctgcaagaagctagactgcaccgttgatgaaatgatggaatttactgatgatgaataacaggaggttgctgcaatgacagatacacagcaaagagcagcggcgaaagcgtttgcgaaaaactggaaagaccgtggatatgaaaaaggcgacagccagattttctgggtggagcttctgacaacggtatttggtgtaacggaaatatcacagtttatttcttttgaggatcaggtacatcttgaccacaccagttttattgacgggtatattgagaaaacccatgtcatgattgaacagaaaagtatcaacaagagcctgacggctgctatccggcagtctgacggctctatgctgacaccatttgaacaggcaaaaagatattcttctgagctgccatattcaaaaagaccaagatggattgtaaccagtaatttccagtcattctatatttatgatatggaaaagccgggcggtgatccggagatcattcagttggaagaccttgaaaaagaatactatcggttacagtttcttgtggacgagggaaacacaaatcttcagagagaaatggaagtttccattgccgcaggtgaaattgtagggttgctgtatgatgcactggcaaaacaatatgttgatccgacaacagagcgtgcaatgaaaagcctgaatatcctatgtgtcagaatggttttttgcctgtatgcagaggatgccggcatttttggacagcatggcatgttccatgattatctggaagaatttgatacaaggcatatgagaaaagctgtgattgagctgttccaggtgcttgatacaaaaccagaagacagagatccatacatagaagaatctctggcacagttcccatatgtaaatggtgggctgtttgcaaatgaggatattgaaattccacagtttacggatgaaatcagaaatcttttactggaaaaagcctcagcagattttgactggtcagaaatcagtccgactatatttggtgcggtatttgagagtacactgaatcctgaaacaagacgctccggcggtatgcactacaccagcattgaaaatattcataaagtcattgatccgctgttcttggacgatttgaaaaatgagctgaaagaaattcagcaaataaccgttcagagaacaaaagataaaaagttgagagacttccaaacgaagctgtcaaatctccggtggcttgatccggcatctggtagtggaaatttccttacagagacatatattagtatccgtcgattggagaatgaagtcataaaagaattgcaaagaggacagattacttttggctttgatgaatcttccccgattcatgtttccattgatcagttttatggaatcgaaatcaatgattttgctgtcacagttgcaaagacagctttgtggattgcagaatctcagatgatgaaagagacagaagacatcgttcacatgaatttagattttctgccattgacaactaatgcgtttattgtggaaggcaattctttacagattgattgggagagtgttgtacccaaaaatcaggtgtcgtatattatggggaatccaccatttcatggatttacttttatgacagctgagcagaaacaagatatgcaaaatatttttccaggggtaaagaatcttgattttgtttgtgcctggtataaaaaagcgtcagattatattcggggaacaaaaatagaagttgcttttgtatcaacaaattcaattgttcaaggtgaaacggtatccagattttgggactttatgcaggatgatattattaactttgcatatagaacgtttgtatgggatagtgaagccagtgtaaaagctcatgtacattgtgtgatcattggatttgcgaaattctcacgttcgaataaatatttgtacgataatggaagaactacagtggctgaaaatatcaatcgttatctgatggatggagataatatattagtacgtagccggaataaacccttgtgtgatattcctaaaatgatatatggtaataaaccagcagatggaggaaatttgattattgaagatgaggacttaaatgaatttattaaaaaagatccgaatgcaaagaaatatatccatcctcttttgggagcatcagaatatatcaaagggaataaaagatggtgtttatggcttgttggagcagatccagaagacttgaaaaagtgtccaatgattatggaaagaataaagaaatgtaaagaggcgagagaaaatagcgttgcggctggaataagaaaatttgcagctacaccaacactttttgcacagagaacgcagccagttgataaagattttatcattgtgccgagagtatcttcacaagcaagacgttatgttcctatgggattcattaaagctggaacaattgtaaccgatagggttcaggtaatccctgatgcttcactgtatgactttggaattataatttcaaatattcacatggcttggatgcgagtaacatgtatgcgattaaaaagtgactatagttattcaaaagatgttgtatacaataatttcccttggccagagccaacagagcagcaaaaggaaaaaatagagaagactgctcaagcaatacttgatgcaagagcattgtatccaaatagcagtcttgcaacgctgtatgatgaattaacgatgcctccagaactgagaaaggcacatcagcaaaatgatatggcagtcatgcaggcatacggatttacaaaaggcagtgaagcctataaaagcgaagctgcatgtgttgcagaacttatgaaaagatatcagaaattgtgtgaggaacagaaatagtaaggagcagaaaagttgaaaaataaaaacactgagaaaatagagtttctaaaaatagtatattttgatgaagctgctgcacaggattatgttgatgttacaaatggaggacgacttgattggtcaacacaggaaaataaagaaaaaatagctaaaatagttgctgaaattgaagctcaggcaaaaagtggctttaatattttgaattatattaaagcaacatttcagggaaaagttgatgccagtgcttccgctgaactgaccagtgcttttgacaaaacaataaaaaatacgttgcttacagattatatacaggcagcatcgaaagatgaacacgtaaaaaaattcgagaatagtggtgtttatgcaccagaaaattctgtgacattatataaaatgctcagttcatatttgacaattgtgcctaaagaagaaatgccaatagatatggaaaaattaaatgaggcaatattaggtgaacggggttattatgacatgcttttaaaaacagagatagagcggaaaagcgtattgagatttaaccttcaagcatttaaaaacaattataatcttgtcgatttaagcaaaatgaagctgacatatttcggaataaaggttggaacttgtggagaaaatcatttatcgattgataaagagtttgattttcaaccagcagaagacaagactacagcagaagaaattgtagagggagaaaagtctgctgctgaagaagaaaaagaattagatgtttatgatatagtattggcaggtgtagtacgtgaagaagattgaaatttttgtaggatctgattctgcctttgaaaagattgttccgaaaagtgcaagaaatcttagtgaaatggcagcgaaacttgatgatggtaataaaaaaatggatgtgtttgttaacattccagggcagccagaaccaaagcctaagaaaaagaagaaaccgagagttcaggattttgttattcatgcagatgagtactgtagtgttcaggaacatgtaattataaactttataaattttattttccaaatgtccataacaaatatgtacattcaaaatccaccgaaaagtattcgagaacagatataccgaacatttaataaaagtattattcatgaaacgcaacagccatatttggaagtttcaaaagaaatgatacaaacatttaatagccaatatagtgaaaggataattggacaggaaagagcaaaaaagaaattgcttcaagcaatatatcctctggtagatggtaaacaaagcaagccggttgtaatattgttatatggagattcaggacttggaaagacagaatccgcacaatatatggcagaattgatgggtggaaaattattaagaaaacaattttctatgtatcagaataatgagtcggccaattatatttttggtggaagatataacgaaaaaagctttgcgcaagatcttttggctagagaaactaatgtattgttgtttgatgagtttgataaagctttatctatattccatagtgcattttatcaattatttgatgaaggaatttatgaagatcataattataaagtggtagtaaataaggcaattattatgtgtacttcaaattataaaacaattgatgagataaaagaacatttaggattgccgatatataaccgttttgattcaattattaaatttaatgatttgtcaggtatggcaaaagaaaaaattgcagagagagaaatagaaagactgagggaagattatgatattgaagacagagagttatttgacaaaataaagaaaggtgcagttactcagtcaaatgcaagagaaataaaacatttgataaaggatactttctctcttgtggcacttaataaaatatgcggtgaaacagaaatataattctcttagcaaagctaagagcgcacttctatacaggcaattccatctgcctgtatcgtgcgacctgcggtgctattcacggattcgaggaatcttaatccgtgaaatacagcgaaatcagagatttcggacaaggggatgtttccccttgcggcacaggtgcctatccccgaagtttgtgactgaatacctcagatacaaacatataggggaaagaaagcgtgaaatcggaagttgtggagggaaaatcaatgaaagaaaaaacatatcagactccttgcggaacaatccactattgggtaagcgtctcacacccagatgaaattactcttgtttttctgcctggattgactgccgatcatagattgtttgataagcagattcaacatttcaaggagaagtataatgttgtggtatgggatgcaccggcacacgcctcttcatggccgtttcggtttgagttcgacttgttcgataaggcaaaatggctgaacaacattttgaatcaagaaaaaattaccaagccggtcattattggtcagtctatgggtggatatgtgggacaggcttatgcacagctttacccaaatcgattaacaggttttatctctattgactctgcaccgctgcaacggaactatgtgactgcggttgaactctggcttttgaagcgaatggaacccgtatatgctcattatccgtggaaattgcttctgaaatcgggaacggaaggagttgccatgtctgattatggcagaaatctaatgcgtgaaatgatgttggtctatgatggtgatcaaaagcgttatgcgcaaattgcggggcatggctttcgcattttggcagatgcaatggaaaagaatctgccatatgagctgaagtgtccatctctgttaatatgcggaacgcaagaccacgctggttcatgtatacggtataacaaagcatggcaccaaaagagaaaaattcctttgaagtggatcgaaggagctggacataattctaatacagacaaaccggaattgataaacagtttaatagaagaatttgttgcagatgtttaataacagataaattctaattttattgaccaagaaattgaggaggattcataatgagtgagaaaacagagattactttcatgcagacaagattaattcggcttgcttcagaagagtggcatttacctgttgaacagattatccacttgtttaaagaagccgatgttcttggatatatagaaaaatgctatgggatttttcattgtgagggtgatgaagctgtgcttgaagacattacagaatttctggaaggaaaggggataaagattagtgcttgagttaaaagatggatttgttctctatcatggaagttattgtgaggtaaaagagccagatcttgccaaatgtgcaaagagaaaagattttgggcagggattttatttaactacatccaaggagcaggcagaaagttttctgagaacctcaatagccaaagcaatcgcaaccggaacaattgaagaaggacagaagtttggatatatttcaacttttgaattcaacctttcaggaaatcttgaaatgcatatttttgaaaatgcagatgtagactggttacattgcattgccgctcatcgaaagaaaaaaatgtttatcgaagtggaacgtgaaatggcaaggtatgatatcattgcaggaaagattgcggatgatgcaacaaacgctacccttactgcttaccttgccggggctttcgggacagcaggcgataaggaggcagacgatttctgcatcagacagttgttgcccaataaactaaaagatcaatattgcttcaaaacggaagcagctattgagtgcctgaaatttatgaaaggtgagaagatatggctgaagtaacaattccaaaggaaaaaatgaattatacaatcgaccttcttatcactatggtgacagatgagattgcagaagaaacgggcaaggacagaaaagagatattgacagattttctttgttcaaagacaggaaaagcactgtatgatgagaacacaaagctgtggtgcaatggtccagcatatattgctgaattgtatagggaagagttaaagaaatccggatatcagatttgagatgaatgcatattcggattgtgttgaaaacttccgctattatatcgttgtgacaactaaatatttcaaaagttactgaggtcagcatttcctaattatggaacaatgacctcagtttttttatacccaggaatcggcatttatgaatgaaccggttctttttatttacagaaaagaaggaggacgacagagtgagcagagcaaaaaatccgaaatacgaatccatgtcgctggaagaattgaaggcaaatatggaaaagagcagacaggaactggaggcggcaatccacaataaaaatcttctggaacagaggaaaaagctggtggaacgcagagaacgttcccaccggctgattgtcaaaggggcagagtttgagaaagcgtttccattgtcaagagatctggaacaggaagaatttcaggaggtaatgaaccagatgcgtaacagcagttacaacaagagtgttgtgcggcagaattatatagctgcttcacaaaaagacagacaagagattgccgaagcagttaaaaaaacagagaagggagatgacagctaatggcactgtatcatttttcagtaagacatgtatccagagggaaaggacagatggtgatcgcttccgcagcctatatttccgggcagaggatttttgacagttattacaacaagatacacgattatacaagcaagtcgggtgtggtatttacagaaatcctgacaccggagtatgtgccggagcgtctgactgacagggaaaccctctggaacgaggtggagcatgtggaaaggaacaacaaggcgcagcttgcctattcgtttgacattgccctgcagaatgaactgacacttgaggaaaatatcagattggcgaaagagttctgccaggagcagtttgtggcacgtggcatgatcgtagatctggcaatccatgagggaaaatcggacaatgaagaagaaccggataatccacatttccatgtgcttgtaccaatccgtccttttacagaggaaggaatctggggcaataagcagaggcgggaatatattcttgatgaggatggaaaccgggtgaaggatgctaaaggaaaggagatgttcaatgctgtttccactaccggttggaatgatccggagcttttaaaggagtggcggagagcatggacagagaaagtaaatggaaaatttcgagagtgccacatggcagccagaatcgaccaccgttcctacaaagaacaggggattgacctgatcccgactatccacgagggatatgaagtccgggcaatggagaaaaagggaatcaaaacggtgatcggagaattgaaccgggcaatccggcagttcaaccagatgttcatttccctgaaagaatccattcagtggatgaagactgtttatgaagaaatgaaagccgagctggatcgcaggcagaacccgacactcctggaaagcctgcaggactattatgataaaaagacacagggaagaccgccacttcctaatttctatgcggagatgaaacgaagaggtaagaatctctcaaatctacaggaattttcaaaatccatcaattatcttcagacacatcagatagagacgatggaggacttgcaggaacggattgaggaattgaacggtgttgtttctgtcagtaaaaaagaaatttccgaaaagcggaaacagttaaaggaactggagaatctggaaaaaatggcagaggtaatcaagacgaaccagccattgattgatgagtacaatcatttttttttccagaaaaaacgggagaaatattatcagcagcacaaaaaagaaatcaattattaccgtaaatgtgaacgggaactaaaacagcatctggatcaaaatgggaaagtcccaactgccagatggaaacgggagaaagaagaactccagtcggtgatcgaagagctgaaagcagacaatcagccgtatcaggaggaacttgcgtttgtaaaaaaggtacagagctgtgcagacattgccagacgtgaccgggaaatggcagaagcagatacttccgggcgttcagaagaaaaaatggaggagcagaaaccagaaaagaagacttccctcttgagaaaactggatgaaaagaagaaagaatgtgcagagcgtgatgcaaaacaacaggcagtgaagaaaaaacggaactatgagatgagtttataacagtctgtcagcaggacagacaggaaaggatgaggaaaatgcagtatacggaagaacagattataagagcaaaccagacagatcttgtatcttttctgaacgcacagggagaacaactgatgaaaagcggaaaggaataccgttggaaaaagcatgacagtgtaacagtgtctggaaataggtggtacaggcacagtcaggggaggggtggctatccggtggattttgtgatggaattttacaatgctacgtttccggaagctgtcaagatgctgaccggggaggaaggcgaaggcaggaacagtgcctgccccgccccgtcccctgacttccggttgccagagaaagaggaaaataatgatagaatcatcagatatctgacagaaaacagagggattgaaaaaaatctggtggagaaatggatcagcagtggggatatttatgaagaaaagaagcaccataatgtggtgtttgttggaaaagatgcagatggtattccaagatatgcccattgcagggggacaggtgaaataaaataccggggagatgtggctggatctgataaatcttgcggattcagtcacagagggacggataatcagttgtttgtgtttgaggcagccattgatctgctttcttttatccagttgtttcccaaagactggaagaaacgaagctacctgagtctgggtggcatctccggtgtggcactgatggcttttctttctgaacgccctcagattacttctgtatttttgtgcctggataatgaccagccagggaatgaagcctgtgagaaactggcagaagaaatcccggacggatacagtgtcatccgtctgaaaccgtcccgaaaggactggaatgaaatcctttgcgataaaagtgcggacaggaagaaagcaatcattgaaacagttacaatgaaagcaccggaagaactagtgccgatgctgtgctatgaagatattgagcagaccagtgtagaatggctgtggtttccctatctgccatttggaaagctgacaattatccagggcaatccgggagagggaaaaacttattttgccatgatgctgaccgcagcctgtacgaaccggaagactttcccgaatatggaagagattgaaccattcaatgtaatataccagactgcagaagacggtatgggagacacaatcaagccgagactggtagaagccggtgctgatctgagccgggttatggtcattgatgatacagaagaagcactgacattatccgatgaccgtatcgaaaaggcaatctgtcagaatcaggtcagacttttaatcattgatccggtacaggcatttatcggtgccgacgtggatatgaaccgggcaaatgaagtccgtccggtatttcgaaaactgggaatgattgctgaaaagaccggctgtgcgattgtgttgattggacatctgaataaatcttcgggtacgcagagtacttaccggggacttggctctattgatatcatggcggcagtgagaagcctgcttttcatcggaaaagtaaagaaagacccgacaacaagagtactgattcatgagaaaagttctcttgcacctccgggtgagacgatggcatttaaacttggagatgaagaaggtttccgatgggtgggagcttatgagatttcttccgatgatcttctggatggaaaggaaggaaagccgacagaaacaaagctgcaacgaggaacgaaactgatctatgaactgcttgcggacggaaatgcagtcacaattcgggaattggatgaaaaggcaaaatcacagggaatctcccagagaaccatgcgtgaagccagaagccgaatgaaagaagaactggattatcagatgaatgaaaaacaggaaaataccattcgattaaaaaaataaaagagaatgggtgacggcaggattttggagtggacggcaggctttatagataccctacctgccgcctgccgtctgcccgtgcaaggcaatcgaacgaaaacagtaggtatccatacgaaaattcaaaaaggcaatcaacagtctgggcagttaatctgtaaaaatggattacctgcttttttttacccaaaatggaggttttacaatggcagcgatgaagaaaatcatcaatatcaaagtatattttgacggtgatcaggacgcaaaagaagtatttgccgaagtgatcgcacagaaaatacgtgacacgaaaacaaaagataaacttgcaataatgaaagataagcagtataatgattatgagttcagtaatctgaaatctgcgtaggatgtgcaacgtaacggaggtatcagatgaacaacagatatatgagtaacaatacagacagaaatgcaacatggagagttggcgtatattgccgactttccaaagatgacgaactgaccggagagagcgccagcatctccaaccaaagggacattctggtgaattactgtcagtcacagggctggcaggtggtggatgtgtttcaagacgatggttatacaggattgaacacagaccgaccggacttacagagacttctcaaagcctgtgaaaaaggactggtgaatcttgtaatcaccaaagatcagagccgactgggacgaaaccatgtacagacaggatttctgatggaagagttttttccgaagcatggagtaaggtatatcgcattatacgacaatgtggatacctttgacggggacaatgagattgctccgtttaagaatgtactgaatgagatgtattccagagacatttccaagaaagtccatgcgtcctatcacctgcaggcaaccaagggcaagtttacaggcgttgttccaccactgggatatcagaaagacccggaggaaaagggacatctcctgattgacgatgagacagcaccgattgtccggaaaatctttcagtgggcggtggatggtcatgggattaacttcatatccagagaactggaacgccagcagattccctgcccgtcatggtggcaccggaaacggggactccgtacctattacacaaaatgggaaaagaaagaccctgaaaatgggaaatatgtatgggatgaatcctatctgaaatccctgctgatgaatcccgtttactgtggtgacatggcttcccagaagaggtactaccgttttaagattggcaatcagggagataaagctccggaggactggatcacagtcagggatacccacgaagcaatcattccacaggatgtatttgctctggtacaggcgaagatgaaaggcaggaaacgccagacagaacagggagaatacagtatgtttgccggtttactccgctgtgcagagtgtggcggtgcattaacattaaagaagacacacaccaaagaccaacatgaagtttatacctgttccacttatatccataaggggaaagcacactgcactcagcaccgagtggacgctgatgatctgtatgatgcagtccttaccagaatccaggaatgtgcaaaagcagtcaccggagatggaacagaactggaagacagggtaaaagagttgtgtgaggaagatacgcagggacacagagacagtctggagaagctggtatcaaagcagaaagaccgtctggagacgttagaccggctgattgcaaaactgtatgacgacctcatcaatgacaagattacagaatctgtttttgataagatgttggagaagacgcagaaagagcagtcggacatcaaaaaggaactttcccagaatgagagtgtgctgaacacagaagaaaaactggacgcacagtcccaacagtggattgacgatatcagcgagtatgcggatatcaaagaactggatgccaatcttctgaaccggctgatcagtaaaatcattatctcagaaccgcaggagaaagacggaacagaaaattaccgccgtactcctgaaacggttacaatggaaattcatttcaatttaaaatcaataccggagcttggaaccatcgaaagaggttccggctcccataaataagaaaaatctatcaaaatttaatctattttaatcttttcaaggctcatttcgagccaatattttctcataaaagacataaaacagctcatggccggcgctggtgtagccgtagtcggcatggtccttgtacctctgctctccgggctgttctctgtctaagcgttcctgcatgaaatccttgccgctcccgcagctctgcgggggcggcggaaaggaggttgacaccgtatggatttcttacttgaagccctgacgaattggctgaaagaaatgctggtgggcggtattatgagcaacctttcggggatgtttgacagtgtaaaccaacaggtcgcggatatatccgtacaggtaggacagaccccacagggatggaatggcagtattttcaatatgattgagaatctgtcaaactccatcatggtgccgattgcaggcgtgatcctggctatcgtgatgaccgtagacctgatccagatgattgcagacaagaacaacctgcatgatgtggatacctggatgattttcaagtgggtgttcaaatcagctgccgccatcctcattgtcacaaacacatggaatatcgtgatgggcgtctttgatatggcgcagagcgtggtggcgcaggcggcagggattatcaattcggatgcgtccattgacatttcctcagttatgaccgatctggaaccgaggctgatggaaatggatttgggaccgctgttcggactgtggttccaatccctctttattggcattaccatgtgggcgttgtatatctgtatctttatcgttatttatggccgtatgatcgagatctaccttgtaacttcggtggctcccgttccaatggctgcaatgatgggcaaagagtggggcggtatgggacagaattacctccgatccctgctggcactgggctttcaggcgtttctcattatcgtctgcgtggcaatttatgctgtgctggtgcagaacatcgctctggaagatgacatcatcatggcaatctggagctgcgtgggctacaccgtactgctatgttttacgctgttcaaaaccggcagtctcgccaaatcagtctttcaggcgcactaaaacggaaggaggtttccacagtggcttatgtacccgtacccaaggacttaacaaaagtcaaaacaaaggtcatgttcaatctgaccaagcggcagcttatctgcttcacgggcggagcgcttattggcgtaccgcttttctttttgctcagaaaacctaccggaaacagtgtagcggctatgtgtatgatgctggttatgctgcccttctttatgctggctatgtacgaaaagcatggacagcccctggaaaagatcgtgggcaacattctcaaagtagctgtaatccgtccaaagcagcgaccttaccagaccaacaacttttatgccgtattaaagcggcaggaaatgctcgataaggaggtgtatgacattgttcaccgcaataaaaaaatggctgcatcggatgttcggaaaaaccgaggaaaaaactgtgcagccggtaaagacaaagaaaaaactgtcccgcgccgataagaagcagatcgaagcggccattgcccgcgctaaccgcacggacaaaaaaggaaaatctgcgcaggacagtatcccttatgaacggatgtggccggacggaatctgccgcatatcggacagccactacacaaagaccatccagtttcaggacatcaactatcagctctcccaaaacgaagataagacggcaatctttgaggggtggtgtgatttcctcaattattttgacagctcgattcatttccagctgtcttttttgaaccttgcggcatcggaggagacctttgctaactccatttccatcccgccccagagggacgcctttgacagtatccgcgaggaatacaccacaatgctgcaaaatcagctggccagaggtaacaacggtctcatcaagaccaaatatctgacctttggtatcgacgcggacagcatcaaagccgccaagccccgtctggagcgtattgagacagatatacttaataacttcaagcgtcttggtgtagctgccagaacgctgaacggtaaagaaaggctttttcagcttcatgcggtattccacatggatgaacaactcccgtttcagtttgaatgggactggctggctccttccggtctgtccacaaaggattttattgcaccaagctcttttgagttccgcaccggcaagcagttccgtatgggcaagaaatacggggctgtttcttttttgcagatcctcgcaccggagctgaatgaccgtctgttggctgattttctggatatggaaagttcgctcattgtgagtatgcatattcagtcggtggatcaggtgaaagccatcaaaacggtaaagcgaaagattaccgacctggaccgcagcaagatcgaggaacagaaaaaagcagtccgtgccggatacgacatggacatcattccatctgaccttgctacctacggcagtgaagcgaaaaaactcttgcaggatttgcagagccgcaatgagagaatgttccttttgacctttctggtgctgaacacagcggacaatccccgtcagcttggcaacaacatctttcaggcaggctctattgcccagaagtataactgtcagctgaccaggctggacttccagcaggaagaagggctgatgagctgtctgcctctgggcctcaatcagatagagattcagcgaggactgaccaccagttctacagctatctttgtgccctttactacgcaggaactgttccagaacgggaaagaagctctgtactacggcatcaatgctctgtccaacaacctcatcatggtggacagaaagctgctgaaaaaccccaacggcctgattcttggtacgccgggttccggtaagtccttcagcgcaaaacgagaaattgccaactgttttttgcttaccagcgatgatgtcattatctgtgacccggaagcggagtacgcacctcttgttgagcgtctgcatgggcaggtcatcaagatctcacctacttcaaccaactatatcaatccgatggatctgaatctggactattcggatgatgaaagcccgctgtcactcaagtctgactttatcctcagcttgtgtgagctgatcgtgggcggtaaggagggcttgcagccggtgcagaaaaccattattgaccgttgtgtacggctggtttacaacgaatatctcaatgacccaaagccggagaatatgccgattttggaggacctttataacttgctgcgggagcaggaagaaaaagaagctcagtacattgcaacggcattggaaatctatgtaacgggttctttgaatgtgttcaatcatcagagcaatgtggatattgataaccggattgtctgctacgacatcaaggagctgggcaagcagctcaagaaaatcggtatgctggtggttcaggatcaggtatggaaccgtgtcaccatcaatcgtgccgcccacaagtccacccgctactacatcgacgagatgcacttgcttttgaaggaggaacagaccgctgcttatacggtagaaatttggaagcgattcagaaaatggggcggtattccgacaggtatcacccagaatgtcaaagaccttttgagcagccgcgaggtggaaaatatctttgaaaattccgacttcgtgtatatgctcaaccaggcaggcggagaccgtcagatcctcgccaagcagctgggtatttccacacaccaattatcttatgtgacccactccggtgagggcgagggcctgctgttttatggctctacaatcctgcctttcgtggatcacttcccgaagaataccgagctttaccgcattatgaccaccaaaccccaggaactgaaaaagaaggaggatgaatgatgatgaaccccaacattttgaataaaaatccgctgatgttttttgacagggcggtaaatgcccagcgcagtcagctgcttacagtcatggccgatgcggtaagtgagtgccgcacggcggcagaccaggcagccgaactgaatgagaccggtcaggtggggcttctccgtctggcagaggtctggagcgccattcgtgctaaagaaggtatgggcggcctgattctggaaggaacagaggcgaagatcctgtctgatgtggtggcacagttttatgcctacctgtccggctgtatgttcaacgatcctgtgggaatggccatttatgcagagctgcactacatgatgtcctccctcatgctgggagaatggtttgaataaagagccgcgcctgcgctttactgatgaggaacggtctgatcctgcactggaaaagccgatccgtaaagcggagaaagctgcggccagagcagataaggcgcaggccaatatcccaaagaaaaaggtcaggcagacggtcattgacccggataccggaaaaaagacctcgaagctgacctttgaggacaagaaaaagccaccttccaaagtttctcaaggagtcagggaagctcccgtccatctggtcgcaggcaagctccacaaagagatccgggaaacagagcaggacaatgtgggcgtggaaagcgcccacaagtccgaggaagcggtggagaccggcgcttatctggtgcgggagggctatcgcagccacaagctgaagccgtaccgcaaagcagcacaggcagagcgccaactggaaaaggcaaatgtaaatgttctgtaccagaaatctttgcaggaaaatccccagtttgccagcaatccgctttctcgctggcagcaaaagcaggccatcaaaaggcagtatgccgccgccaaacacgccggtcagactgccggaaataccgcccaggctgcatccaaaaccggaaaagccgcaaggacggtaaaagaaaaggcacagcaggcaggggcgttcgtcatgcgccacaagaagggtttcctgatggcaggggttttgttcctcattacctgtatgctgatgaataccatgtcctcttgctccatgatggcacagagtataggttccgttctctcaggcactacctatccgtcggatgactcggaaatgctggcggtggaggcggattatgcagccagagaagcccagttgcaggagaagatcgacaacatcgaaagcagccacccagggtatgacgagtatcggtatgaccttggcatgatcggccatgaccctcatgagcttgcggcatttctctctgctgtcttgcagggctacacccggcaaagcgcccaggcggagttggcgcgtgtgtttgcagcacagtatcagctgacgcttaccgaggaagtggagatccgctaccgcacggagacctccaccgacccggagactggcgagaccacctcagaagaagttccctatgagtattacattctgaatgtgaaactcaccagcaagcccatttccgctgtggcgtcggagttactgaccccggagcagatggaaatgtatcaggtttaccggcagaccatgggcaataagccgctgttgtttggcggtggttcccctgacatgagcaattccgaggacttgaccggtgtacagtttgtaaacggtacccgccccggcaatccgcagctggtggaactggccaagcgtcaggtgggcaatgtgggcggctatccttattggagctggtatggctttgacagccgcgtggagtggtgcgcctgctttgtatcctggtgttataaccaggctggaaaaagtgagccgcgctttgcaggctgtgagtggcagggcgttccgtggttccagtctcatggacaatggggtgcaagaggctataataatctggctcccggagatgcaattttctttgattgggatttggatgggacagcagaccatgtgggtatcgtgatcggtacggatggcagccgcgtttataccgtggagggaaattccggcgatgcctgcaagatcaaaagttatgacctgaattatcaaagcattaaaggctatggtctgatgaactggtaacagactttgtggaaaggagtgaacggttatggcaaaaaacaaaattgaacgtatcgaccaggaaattgagaaaacccgtgagaagattgcggactatcaggaaaagctcaagaccctggaagcacagaaaacggaggcagagaatctggaaatcgttcagatggttcgtgcgttacgcatgacgccagcacagctgaacgctatgctttccggtggaatgaaccacggtagagatacagcactgtcggaatcaaataatcaggaggttaccgcttatgaagaataaaagaatttgcaaaacactttccgccctttgcctgacaatggttgtggcatttggctttacgatccctgctttcgcacaggggtcagaaccggcaccggcggcaccggcagaggattctaccaatgacagcaatgtgattgtggaagaaacagaaccggcaccggcacttacaccggaggggaatgcggcattggtggatgattttggaggcaataagcagcttattactgttacgaccaaagctggaaattacttttacatcctgattgatagggcgaatgaggacaaggagactgctgttcactttctgaatcaggtggacgatgcagaccttgcggcgctgatggaagatggaaaacccaaagaggagatgcctgcggtatgcagctgttcaacaaaatgtgaagcaggggcagtcaatacggcctgcccggtctgtgcaactgataagagtaaatgtacgggcaaagcaccggaacctccggcagaaacatcggagccggaaaaggagaagcctgccggattgaacccggctgcgatagtccttttgctggctctgctgggaggcggtggcgtatttgcctacttgaagctcgttaagaataagcctaaaaccaagggaaatgacagtctggacgattatgattatggagaggaagattccgaggaatgggaaaccgaggatgaggagtcggaagaaccggatgctgacgggggcagcacagaagaagatgatgaggacagtgtgaaatgacccgtttcacagacagtccctatgaacgcatgatgacacgcaggccggagggcgggaaggaaacttcccgtcctccttctttaccccacagccacccctgctatggttgcgggaattatggaagaccctgcgtaggtatctgtcaccgggaaatgtcccgatggctcaaagagaggaggaaccatcatggctcaacataaattggtaattgccgaaaaaccatcagttgcccagagtttggcggcggtgatcggcgcaaccgtccgtaaggacgggtatctggagggcaacggctggcgtgtcagctggtgcgtgggccacctggccggtcttgcggatgcagacagctatgacccaaagtatgccaagtggcgatatgatgacctgcctatcctgccggaacattggcagatggtagtgggaaaggataagaaaaagcagtttgatattctgaaaaagctgatgaatgtcccggatgtgacggaggtggtaaatgcctgcgatgccggacgcgagggtgagctgatcttccgcagcgtctatgagctggcagactgtcaaaagccgatgaaaaggctctggatttcttcgatggaggactctgccataagggaaggctttgcaaacctgcgccccggtgcggattatgacggaattcgggatgctgccctctgccgtgccaaggccgactggctggtgggaatcaatgccacaaggcttttttccgtgctgtatcaccgcaccctcaacatcgggcgcgtgatgtccccaacactggcgctcattgtccagcgagaaggtgagatcgacacctttcagccggttcccttttataccgtggcgctggagctgcccggtcttaccgtatccggggagcgcatggcgaataaggccgctgcagagcagctgaaagaagcctgtcagggtgcaaatgtcacaatcaaaaaggtggagtgcaaggaaaagtccgaaaagccgcctgccctctatgacctgactaccctgcaaagagatgccaaccgcctgcttggatttacagcccagcagaccctggactatctacaaagcctgtatgaaaagaagctctgcacctatccccgtactgacagccgctatctgactggtgatatggcagacagcctgccggtgctggtgaatctggttgccagtgctatgccgtttcgcaaagggatcgccattacctgtgatccgcagacggtaatcaacgataagaaagtaaccgaccaccacgcagtaatccctaccagaaatctcaaggatgcagacctttctgcccttcctgcgggagaaaaagcggtgctggagctggtggccctgcgtctgatgtgcgccgtagcccagccccatatctattcggaaaccgttgtgattgcagcgtgtgccggtggggagtttaccacaaaaggaaaaacggtgaagcaccccggatggaaagcactggaggacgcttatcgtgccaaaatgaaggatacagagccgaaaaaagagggcgtagagaaagccctgccggagctgaccgaaggacagacactttcggtttctgcggcaatcgtcaaagaaggcaaaagcagtccgcctcagcactttacggaggacaccctattgtccgcaatggagactgccgggaaagatgatatgccagaggatgctgagagaaaaggtctggggacaccggccactcgtgccggtattttggaaaagctggtatctgccggttttctggagcgaaaaaagaacagaaaaacggtgcagcttcttccttcccacgatgcagtatcccttatcacggtgctgccggaacaactgcaatcgtcgcttctgactgccgagtgggagtatcgcctgggcgagatcgagcgcgggcagcttgccccagaggagtttctggatgggatcagcaccatgctgaaagatctggtggggacttatcaggtcatcaagggaactgagtacctgttcactccgccccgtgaggtggtgggcaaatgccctcgctgcggcggtgaagttgcagaactgcaaaaaggcttcttctgtcagaatgattcttgcaaatttgcaatctggaaaaacaacaaatggtgggctgccaagaaaaaacagccgaccaaggctgtggtgtctgcgctgctgaacgatggccgtgtccgtgtgacggggttatattcggagaaaaccggcaagacctacgatgccactgtggttttggaggacgatggacagtatgccaatttcaagctggaatttgaccagcggaaaggaggcagccgatgaagctctctttagtggaacgggaaaccattctcctctataaccaggcagaaccaatggctgaggtctacacccacgatccccgcctgatggagaaactggaactgctggcaaaaaagcaccccgaccagatcacccgaaaggacgcccataactttaccgtccctaagcggtgtgtatcagtcagggagccatacagcgcagaacgccgcaaagctgccagtgagcgtgcgaaagccgccggataccagccccctgtgaaaaagtccggcagttaaaggcacatggcagagaatgtgtttgaagcagtcaagcagtcggtcagcaccagagaagcggcagagttttatgggataaaagtcaggcgaaatggcatggcctgctgtccttttcacgatgataagaaccccagcatgaaggtagaccagcgattccactgctttggctgcggtgaagatggggatgtgatcgactttaccgcaaagctctttgacctctccccaaaagaagcggcggagaaactggcacaggactttggcctgatctatgacagtcaggccccgccccgcaggagatatgtccggcaaaaaaacgaggcacagaagtttcgggaggatcgacagcgctgttaccgtgtactgtctgattactactatctgctgaaaaaatgggaagccgaccgttctcccaggacaccggaggaagaaccgcacccccgctttgtggaagcaatccagaagaaaacctatgtagagtacctgctggacctttttctttatgaaagtgaagaagaacaaaaggcatggattgcagaacacacagcagaaatcacacacttggaaaggagattgaaaatcatggctgagaataaacccaccaaccgagaacggctaagggaaatcacagatggcatcgagcagggcatcaaagaactgtttgaaagcgaaaagtatatgcgctatctgtccgtcatgtcccgatttcaccgctattcggtaaacaacaccatgctcatctatatgcagaagccggacgccactttggtagccggatacaataagtggaaagaccagtttgagcgtcatgtaaaaaagggcgagcatggcattaccatcatcgctcccacaccgtataagaagaaaatcgaggagcagaagctggacccagataccaaggctccgattctggataaagacggaaagatcgtcacagaggaaaaagaaatcgagattcccatgtttcgccctgtcaaggtctttgatgtgagtcagaccgacgggaaacctttgccggagcttgcttcctccctttccggcaatgtgccaaattatgaggcattcatggaggccctgcgccgcagcgcaccggtgccgattacttttgaagcaatggccgccgatacggacggctatttttctgccgatcatcagaaaattgccattcgtcagggcatgagcgaggtgcagacggtttcggccacggttcacgagattgctcacagcaagctccacaatcagaaaaagatccagattgccaatgacgagcaatatcaggagatcgagctgtttgataaacttggtctgttctccaacggacggattgctcgcgataatctgccagagggcgtttattgctatgatctgcgcggttctgactacgatcctggagatccggtctgtgtggaagaacgagtggttgtaaaccatgcaggctccgttctgctgacagagccgttggaactgacggaagatggacgcttgatgctgaccgaggaaaaagggctgaattttaccggtggcttttctaccctctcccagtttttgcagaaacagaggaaagatcgtcacacggaagaagtggaggctgaaagcatctcctatgcggtctgcaagtattttggcatcgagactggagaaaacagctttggctatattgccagttggagtcaaggcaaggagctgaaagaactgagagccagtttggagaccatcaacaaaacctccggcactttgatctccgacattgagcgccactataaggaaatctgcaaagagcgcggaatcgaccctcatgcaaaggcagagccggaaaccgccccgatagagcaaccaaccagcaatctgacttactatgtagcagagtgcatggaatttccaaacctcggagaataccacgataacttgtctttggaggaagcaatccgcatttatcaggagattccggcagaacgaatgaacgggatcaagggcattggttttgagctgaaagacggaagcgactatgaaggaccttttccgattttgaccggccagaccattgacctggacaccatccaggcaatcgactattaccgtgataatcctctggtgcaaaaagcggtaaaggaactggctgcggcaatgccggaaatggaagtgctgggggcggacgccaatcagcaggaggctttgtttctgatcgacaatgccacctatcttcatatccagtcctgtgacagcggctgggactataccctttacgatgccgcatccatgaaagagctggatggtggtcagctggatatgccggagatttcccgcatgaaggcagttctccagatttgtgatgacaacgatttgggcagagactcggtaaaatacgcaccgttgtccatgattgagaccttgcaggaagctgcctaccagcagatgcaggcagaggtcagtcagatggctgcttcttcccagctgccggaagcacaggagcaggcactggatgaataccccatgccggatgagcaggtctccacaccagatatgcaggaatacggctactcctatgatgggatgttccctgttaccagagaacgggcgctggaactggatgccgccggtttgaccgtttatgtgctgcatgaggacaatacggagagcatggtgtttgacccgcaggaaatcatggatcatggcggtctttttggcgtggaccgtgaggaatgggagaaaagccctcagttccacgaaaaggtcatggagcgtcaggaacatcagcaggaacgggaacaagcatttctcgctcagaacagagattgctttgctatctatcaggtgagccgtgacgatccgcagaatgtgcgctttatgaatctggattggttaaagtcccatgacatttccatagaccgcagcaattatgacctcatttacacagctccgctgagggagtctggcacggtaccggagcagctggaaaaactatatgagcagtttaatctgcaaaagccggcggattttcacagtccttctatgagtgtcagtgacatcgttgcgatcaagcaggacggtaaggtatcctgtcattactgtgacagtgttggttttacccagatccccggattcctgccggaaaatccgttgaaaaatgcggagatggccgtggaggacgattacggcatgatcgacggtatcatcaacaatggcgcaaaagagcctacggtggcagagctggaacagcaggcccgcaacggtcagcccatttccctcatggatttggctaccgctgcccatcgggaggaacgggaaaagaaaaagtccgtcatggagcagctgaaaagccagcccaaggcagaacacaaaaagacagcgcccaaaaagagtgtggaaagggagatttgatatgggaaactttacttttgaggaaatgaacctgatgtgcatttacaataccggtagccgcaccggattgatcgacagcctgcgtgagatgcgcggcgagctatcaccggaggaaacggaactgagtgagctgaccgacagcgcccttatgaagctctgcgtgatgaccgatgaggacttttcccagctggagctgtacccggattttgaccagtaaatttatcgtgtaaaaaatatagtgagagaaattgtctgacggataagcgatttctctcactttcatcacaatatcccactatacttagaaagatggatgaagtataatctaagcaacaaacaataatttgtaggggtgattaaaatgaaatgtccgtattgtggtgaagaaatgcaacttggttgtattcaatgcagagatggtgtctattggagcgaaaaagaacgagttattgcggccctcaacattggtgggggcaagtcaatcaaactcaatgaaaagtcaatcggtggaccttttggtggagcgtctgcggaggcttggctctgcgagaagtgcaagaaaattgtcattgagtattaaatttcagtttgtttgtgcattgatgattatcttgaacttaggaggtgtttaatgaaaacggttcttttacatgggttgggacaaactgcacaggactggaaagaagtagtccaacaactatcaatttccgatgtcgattgcccagaacttttttcttcagcagaagatgaaatatcatattcgcagattttgggcgatttagaacagcggtattcagaagtaaaagagccgcttcgtatctgcggcctttcgttaggtgcgcttcttgcgattgattttgctattcggcatgaagaaaaagtggcttcgctggttttgattggcgcacaatataaagttccaagtttactgatagattttcaaaatcttatcttccgttgtatgccagacaaggcttttgaaagtatgggactatcaaaaagcagcaccataaaattggctcactctatgcggtcattggattttacttctcaattaaacaatattcgttgtccagtgacaattttgtgtggcaaaaaggatgctgccaatctaaaggcttctaaaaggctaaaagaactgctaccccaagccactttgcacatcgttccaaatgcaggacatgaactcaataaatatgcaccaaacacgattgcagagatattaaataactaaaatgtaatattcacagttttacttagcaggaaatcatttaggtttcctgcttttcttttacccaaaaaccgaaaggaggacagaacaccatgccaaccaaagctgaactatatgcacagatggcggagaaagtggcaacgcaactcactggaagctggcaggaatgggcagggttccttactacggcagcccgactttacaagtatccgttccatgagcagctgatgatctacgcccagcgcccggacgctaccgcctgtgcagagtacgatttgtggaatgaaaagatgggccggtatgtaaggcgtggctccaagggaatcgctctggtggacgattccggggacagaccccgcctgcgctatgtttttgatatttccgacaccggaacccgtgaacattcccgcactccctggctgtggcagctggaggagcgccatttggattcggtgcaggccatgcttgagcgcacctatgatgtttccggtgatgaccttgccggacagctcaccgaggtagccggaaaactggctgaggaatactggacggagcatcagcaggacttcttctatatcgttgacggttcctttttggaggaatatgatgagtttaacatcggagtacagttcaaggcagcagccaccgtcagcatcacttacgctttgatgtcccgctgcggactggagccggaacgctacttcaaccacgaagatttcatggcaatctttgatttcaacaccccgtccaccatcggggcgctgggaacagcggtcagccagatcaaccagcaggtgctgcggcagatcggcgttaccgtccgaaatgcagagcgcgaagccaaccaagaaaggagcaaacaagatgaacaatcccatgacctatatccagaacggagactatctgattcccgacctgaagctgagccagcagccggagaaacccctgggcaagtacggcaggatgaggaaaacctacctgaaggaacatcgtcccatcctctacaaccagatgctgctgagcgagaagctgtacccgcaccttctggagatcgacgagaccgcccagagcagactggagcagatgatgccccagctggcgaaggaagcgggagccaccgaggaactgaaagccagcgatcccctgaagtgggtggggctgatgaacacctgcaaagctcaggccgaggaaatcctgatggcggagcttatcaacagctgactctaaacctgttcctctccgaagcggaacagatccaatccatagatgaagcagagaatgtagcgcatacatcctctgctttttcttttgcccaaaatgacatcgaccatgtgctgcgtttgggcggcaatacagaccgtcaaagggagcgtgtggttgcagcctttgaaaagcagaaaaccaccgctgagattgctgagatactgaaaacgctgtaccacggcggtaacggccttggcagtgtgagcgcatggtatgccgaggatggtatccatctttcccacgggaagtctgcccgttatgacaggtctgcccaggtcatttcctgggagagcgccgcagagcgtatcggggaacttttggaaagtggtcagtttgcctccaatgtggagcttgcagaagtggcaggctatgaacgatccctccttgcagaaaagctctggtatctgtatcacgatctcagtgaggatgccagagaagccggatatttgtcctgcctgtcagagatcaaaggcaatggtttcccggaggagacccgccacctgatggagcagctgagtgaaccggctttccgccagaccctcaaggaagaatacgctgccttctggactgcctatcagcaggaccgtgacctgttgcgttttcactatcatagaccgagggagatctgggagaacctgaaggaccttgacctgccccgcaggaccttttcttcagagctttcccaagtgccaaccgtccagcactttattaccgaggatgagatcgacgccgccatgaccggcggaagcagtttcgccggtggaaaaggccgtatctatgcgtttttcatggcaaaccatacggataaggagaaagtgagattcctcaaagacgagtatggcattggcggacgctctcatgccttgtccggtgcaacacacagcggcgaagatcacgatgggaaaggactgcactataaaaagcaggactgcccggatgttcacttgaactgggaaaaggttgccaagcgcattacctcacttgtccagaaagaccgctatcttaccgaacaggaacaggcgcagtatgacaaaatccagtctgaaaaggaactggccgaagaagatgccattcaaacacagcagccggaggtggagaaagaaacgccaaagcctatccttcgggagcagtttgagcagtataagcctgtggtgactgccgctatttccgaggatgccgcataccgcaatgcctgcgggcattctgaccgtgaaaatgctgtcatcgagggcaatgccgctgtgcgccgtgcggttcttggttctaaggatatggagctgatccgactctattcggatgtgccggagttccgtcagcgtctgcaccgggaagtgatcgacgagacctatccaaagctccatgagcttctgcgccctctttctcaggaagatattgatactgtcctttgtgcatggaacggcaatatcgagagtaaacacgctgttgtccgctatatgaaagaccatgcaagagaaaaagataccgccgcatggctggctcaggaatacggcggcagtaacagcaacagcctgttcgttgtccgtgccggcagcccggaggaaacgcagctgccctggccgaaggtacagcgcaggcttgcccagctcattcaggaggaacggttttataccgaagaagaacaggatcgttttgacaacatcgacccaatcgccatccgggaagctctggaggaaagagggattgtcaacggccaggtggcagacccggaaaaactggacaatgatccgtttatccaacaggtgaggtcagatgcagagcagattgcagatgccgagacagagcagacttccgaagtttccatttccgatgaggaatatgacgcagttcgccgcccaattccgcaaagaacctcctatgacccagccgccccggtctatgccgtgggcgataccgtgtatatcgaggatgacgcctatcagatcaccgagctgcgggaggacaccgtacagcttctgcccaccgggatggtatatcccatctaccgggcagagcgcaaagaacagttcgagcagctgcttcgggcagaccgccgcaatgcttactataccgagtttcttcctattgacccggacaaggcagaacaagacttgcgggatgtattggctcatggactgatggatgaagcggataaaaagcagatttccacgctgctgcaatccggcaggagcaacagcgagatcgcctactggctgagcagagcctattccggtgagattgagacactgaatctggagaccggcgatattgtcgattaccgtaccacggcacagggcatagaactggaagtcatggatgcagaggaaaagcgtctggctatgctgtatttccgctgggatgaggttgcgcctttgctgcgcgggatgtatgcccgtcagcaggacggttttggacaggaacagccccaaccggctaccgaatccccgaccttccattccgagaccatggccgtctatccgggcgataagaacaatctgccttatgatgtggtggtggaacgactgcatatcgaggagccggagccgccagcccctgtgactgagccggagaaaacctttgaggaagtgctggacgaacacccggtttccattcaggtcaatggccagtggcagacctttcccaatgccaaagctgccgaggaagcatcttatgaggaatacaaggctaacctgcgccgcaatgcaaaaaacttccgcattacagatgagcatttgggtgagggcggtccgaaagccaagttccaggcaaatgtcaatgcgattcgtttgctgaaagagctggaagctgccggacagcaggcaagccccgaacagcaggaggttctttctcgatatgtgggctggggcggtctctctgatgcgtttgacccggagaaaccggcatgggctttagagtatgcccagctaaaagaactgctgaccccggaggaatatgccgccgccagaggttccaccctcaacgcgcactacaccagtcccacggtaatccgggccatctatgagaccgtgggccgcatgggttttgagaccggcaacatcctggagccgtcctgcggtgtgggcaatttcttcggtatgctgccggaagaaatgcgaaacagccgtctgtatggcgttgagctggattccatcagtggacggattgcaaagcagctctaccccaaggccgacatcaccgtggccgggtttgagaccaccgacaggcgagatttctatgaccttgccattggtaatgtgccttttggccagtatcaggttcgagataaagcctatgacaagctgaatttcagcatccacaactacttttttgccaaagcactcgaccaggtgcgtcccggcggcgtggtggcctttgtcaccagccgctatacgatggacgccaaggattccaccgtgcgccggtatcttgctcaacgtgccgagctgctgggagtcatccgtctgcctaatgacgcgttcaaaaagaatgccggtgccgaggtggtatccgacatcatctttctccaaaagcgggatcgcccgctggacatcgtgccggaatggacccagaccggacagacggaggacgggtttgccatcaaccggtattttatcgaccacccggaaatggtgctaggcagacaggagccggtaagcactgcacatggtatggactacaccgtgaaccccattgaggggctggaactggccgatcagctgcacgatgccgtgaagtacattcgcggcacctaccaggaggccgagctgccggagctgggcgaaggcgaagccattgacacctccattcctgccgaccccaatgtgaagaactattcctatgccattgtagacgggcaggtgtactaccgggaaaacagccgtatggtgcgccctgacctcaacgccaccgccgaagcccgcgtgaaaggtcttgtgggactgcgtgattgtgtgcaggaactgatcgaccttcagatggatgcagcggttccggacagcaccattcgggagaagcaggcggaactgaacagcctctatgacagcttttctgccaaatacggtctcatcaatgaccgtgcaaaccgtctggcctatgcagacgattcttcctattacctgctctgtgcgctggaagtcatcgacgaggacggtaaactggaacgtaaggcagatatgttcaccaagcggaccatcaagccccatcaggcggtggctgtggtggatacggcaagtgaagcactggcggtgtccatctcggaaaaagcctgcgtggatatggactatatgagccagcttaccggaaaaacaaaagaagaactggccggagagctgcaaggcgtaatcttccgtgtaccgggacagttggagcaggacagaacgccccattatgtgactgctgatgaatacctctctggcaatgtacgccgaaagctgcgtcaggcacagcgggcagcacagcaggacccggtttatgcagtcaatgtggaagctcttaccgccgcccagcccaaagacctggatgcgtcggagatcgaggtgcgtctgggcgctacctggattgacaaggaatatatccagcagtttatgtatgagacctttaataccccgttttatctccaacgcagtatcgaggtcaactattcgtcctttaccgctgaatggcagatcaagggaaaatcttctgtatcctacaacgatgtggcagcttataccacctatgggaccagccgcgccaacgcctacaagattctggaggattccttaaacctgcgggatgtccgcatctatgacaccatagaggacgcagacggaaaagagcgccgcgtgctgaatgccaaggagaccaccctggcggctcaaaaacagcaggcgatccgggaagcctttagggactggatctggagagacccggagcgccgccagactttggtgagccagtacaacgaggaaatgaactctacccgtccccgtgaatatgatggcagccacatcacttttggaggcatgaacccggccattaccctgcgggaacaccagaaaagcgccattgcccatgtgctgtatggaggaaataccctgttggcacatgaagtaggcgcaggcaaaacttttgaaatggtagctgcttcgatggaagccaaacgcctaggactgtgccagaaatctctctttgtggttccaaaccatctgacagagcagtgggcgtcggagtttctgcgtctctatccttccgccaatatcttagtcaccaccaaaaaggactttgagacccataaccgaaagaagttctgcgcacgtattgcgacgggtgattatgatgccatcatcatgggacacagccagtttgagcgtatccccatcagccgggagcgtcaggaacggcttctctatgaacagatcgacgagatcactgaggggattgcagaggtacaggccagtggcggcgagcgttttaccgtcaaacagctggagcgtaccagaaagtctctggaagccagactggaaaagctgcaagccgaggggcgaaaagacgatgtggtaaccttcgagcagctgggtgtggaccgtttgtttgtggacgaggcccacaactataaaaacctgtttctatacacaaaaatgcggaatgtggctggtctttccacatcggacgcgcagaaatcctccgatatgtttgccaagtgccgctatatggatgagatcaccggaaaccgtggcgtgatttttgccaccggcaccccggtcagcaactccatgaccgagctttacaccatgcagcgttaccttcagtatgaacgcctgcaagaactgaacatgacccacttcgactgctgggcttccagatttggggagaccgtcacagcattggagctggcaccggaaggcaccggctaccgggcaagaacgagattcagcaagttctttaatctgccagagctgatgaacctgttcaaagaagtggcggacatcaagaccgccgaccaactgaacctgcccaccccggaggtggaataccacaacatcgtggcgcagcctaccgaacatcagcaggaaatggtgaaggcactctctgagcgcgcttccgaagtacacagaggcagtgtggacccgtcggtggataatatgctcaaaatcacctcggatggccgcaagctgggactggaccagaggatcgtcaaccagatgctgccggatgaacctggcacaaaggtcaatcagtgcgtggacaacatcatgcagatctggcgggatggcgaagctgacaagctgacccagctggtgttctgcgacatttctacaccgcaggcaaaagctactgcaagcaaggcggcgaaaacgctggataatccactgcttcacgcactggaaggtgccgtgcctctgccggagcaggaaccgacctttacggtatatgacgatattcgtcagaaactcattgctcaggggatgcctgccgaccagatcgcttttatccatgaagccaacaccgaagtgcggaaaaaggagttgttctctaaagtccgtaccggtcaggtgcgtgtccttttgggcagcaccgccaagatgggcgcaggcaccaatgtgcaggaccgtctggtggcacttcatgacctggactgtccgtggagaccgggagaccttgcccagcgcaagggccgtatcgagcgccagggtaaccagaatcctcttgtccatgtgtaccgctatgtgaccgaaggaacctttgacgcatacctctggcagacggtggagaataagcaaaaattcattagtcagatcatgacttctaaatcgccggtacgctcctgcgatgatgtggatgaaaccgccctcagttttgcagagatcaaggctttgtgtgccggagacccacgtatcaaagagcgcatggatttggatgtggaggtatcccgcctgaagctgatgaaagccgaccaccagagcaagcaatatcgtctggaggaccagctgctcaaatacttcccggaggagattgaaaagcacaaaggctttatcaagggctttgaatccgatctggaggttttggcagcgcacccgcacccggaggacggttttgctggtatggaaatccgtggcgatctgctgaccgataaggagaacgccggcgcagcccttttggatgcctgcaaggaggtcaaaacctccgatccggtgcagatcggcagctaccggggatatgccatatccgtggaattttccgcttggaaacaggagtatacgctcctgctgaaaggacagatgacccaccgggcaacccttggtacagaccctcgcggaaatcttacccgtatcgacaattccctcgctcagatgccccagcgtctggaggtggcaaaggcccagctggataacctctatcagcagcaggctgccgcaaaggaggaagtcggaaagccattcctttatgaagaagaactgcgaagcaaaaatgcccgtctggtggagctggatactttgctgaacatcgacggaaagggacaggcacacgccgaggctgttgttgccaaaagcgcacggccttcggtgctggatcatctgaaacgtccggcgacgccccgcagtacagacaagaaaccaaaacagcatgaggaggtgcgataacatgaataccaataatctgaatacagccctttatgaaaagatggccactgagcaggaaaaatatagggactggctgaaaagccagcccccggaagaaatcctgcaccacacctatgaatatactgtccgtgaggatattgtgatggcgatggaggagctggagctgaccgacgcacaggcccaggcgcttttggaatctccctcgccgctggcggatgtgtaccgttattttgaaaagctggagaccggctatatggatatgatccgggacagcattgagaaccgtgccgacgatgtgtgcagagctaaagaggaactgcgaacaacaccaatctatccccattcagctgcctatgcgagagaacatggggagctggagcagtaccgagcttccaacaatgtaaatctccaatgcaaggagtccattgaagcggcggtgcgggaacacttcgacggaatgtatctcagccacgatgcggcaaagggtgtgatcgagacctatggcatggagcgtgtatctatggttctgtctaacacgatccagcttcaggactgggatgggcgctactcccgacgcaacaaagaatgggccaagaccattcctaatgataatcccgaaaccgtccgttgtggttatgccttaaacagccaccctgctgtgctggatggttttattgatctggtgcgtgaagaacagcagcgcagccgtacccagagagaaaaactggaaccgtcccgtccctcagtacgggataagctcaaacaggagctgcccgccaataagtctgccgccccgaaaaaacgggagctggagcgataaccatggcaaagcgcaagcgggatgtgccggttctgttttgggtgtccgcagaagaactggaactgatccatcaaaagatgcagcaatacgggacagagaatttgagcgcttatctgcggaaaatggcgctggatggttatgtggtcaagctggaactgccagagctgaaggagttggtctccctgatgcgccgaagcagcaacaacttgaaccagctgacccgcaaagtgcatgagaccgggcgggtttataatgctgacttggaggatatatcccagcggcaggaacaactgtgggagggtgtgaaggaaatccttacccaactctccaaactttcataacagggatagatactccatttgcggagggaggaacggcgtttcttcgccgcaccttcctccgctttttctttttgtctgtatccttgtcttttgcctgtccgtaccggataatatgagtagaataagaagcgtagcaaaggagtgaaaacagatgctgacctttgaaaaggtgctggagatttttgcggattacctgaccgcagacgagaccatagaagtttatatcagccgccatggatgtgtaagagttgaatttgaccaagattttcactattgctctggcgaggtgtgccatactcccaaggaactgttcaatctcttagctgatgattaccggacttatgtggagattgaactgaccaaaggcagacgggagttgacggaagatgatgagagagaagcggatgccctgtgcaaacggtatctggagcgttggagggaggaactggaatgaagattttgaaatgcttgctgatgattgtaactgcaccggtcattttggtgttgacgctttttgtctggctctgcatggggctgatctacatatctggtctggtgcttggtctgctcagcacggtaattgctctacttggcgtggctgtgcttattacctattccccgcagaatggtgcaattttgctgattatggcatttttgattagcccgatggggctgccgctggctgcgatctggctgctgggaaaggtgcagagtttgaaatttgcgatccaggattgggtgtatgggtaaatgatgtgaatataatttggaatgaaaaagaagcaggacaatgggagatgagacccaatgccctgcttctctgtttattcggaacgaactgtaatatatttttgattgcgacttttaggtttatcgggaatagtcatttctaattgcccggattctaaaagcggattgatatgcttcaaggtgaagtttcttaaatctttgaagccgcaaaatactgcaagctctttcttggattttggtgttgtgcaaaaagccaaaatctgtttggataccgttgatagttcaataacttggtgggtaacttggtggataacttggtgggcgtcaccctctaagttgtagtttacatttttcaagatgactctgaaatctgtcgctgttgaggaaaattcgggcttatatgcctctgtgtatccaggcagcttttcggtttcactgacgattttgcgtaggccacttccacggcgttccatgtacttcatgcggtggaacaggtcagcaatcacagggtttcgtcgcatcgaacggatactgtaaatatcgtattcctgaattgagccgccgccaaacataccgcccggagatgtgatttccacccgatcatcaaacatatcaatatggatttcgctgccaagtacaatataatcacgatggataagcgcattaacaagagcctctgtcacagctcgttcagcataatctggcttgtctacacgatactgtgcctctttgacaaaacggactttggaattattgcgaataaattcactgccgcttttcagtagataaatcagattcccttcgtattctttatcgtccagtgcatcatcaaagatagagcctttttccaagccattccaccgggtacagaacatacgggagttataaactgtgtgctgatcggtcatgagctttccggcattggtcaagaccccatttttgtcagccaaaccgaaggaaacataatcggatggctcaaagcggaggccggttcgttccagataggttgcctccaggagtgtgaagctgtaatcctttttcacagcttctgttgttaaggtgtcaaaggactgattggttccctttaagatcagttcatttacaatgtaatccggggcaattacgctttcatttccaacacggatatatgcttccatcactccgtctgccttgtaataatatggggtgctgcggccgggagaaacctccagagctaatagatttttaccatcttcctgtaatggttttaagataaactgaggtaatggtgtgatacgttctttgattaagcggctgatcgcttcagcatccttttgaacatcggacaagccgataggctcccggtcatcggagactccgaaaaacagagtgccgccgattccattggaaaaggcactgacactttttaaccagctttttggcttttttgtttcgagagcaactttgaaatcacattcggttgcttcagcaatgagctgttctatcatagaaatccctcctttgaggttgtagaatattcttttttattatacccagcggagaaagttattgcaacgatagaagcaaagagttcagcgaaaacaaaaatatttatgagaggaggaccttctattatggcaactacaagaatcatgccgcttcatgtcggcaaaggccgcacagagagtcgggcaatcagtgacatcatcgactatgtggccaatccaaagaaaacagataacggcaggctcattaccggctatgcgtgtgacagccggactgcggatgcggagttccttctggcaaagcggcagtacattgccgctaccggacgagtgcgtggtacagatgatgtgattgcctatcatgtgcgccagtccttccgccctggtgagattacccaggaagaagcaaaccggctgggcgtagaatttgcaaagcgttttactaaaggcaatcatgcctttgtggtctgcactcacatagacaagtcgcacattcataatcacattatctggtcatcggtcagcttagaatatgaccggaagttccgaaacttttggggcagcaccaaggcggttcgtcggctaagtgacaccatctgtattgagaatggactgtccattgtagagaatccgaaacttcacggaaagagctataacaaatggctgggcgatcaggcaaatccatctcaccgagagctgcttcgtgtggcgattgacaacgcattatcacaaagtcctgctgactttgaagaactgctgaagctgttgcgagaatatggttgtgaagtctcaaagcgcggaaaatcgtatcgactgaaactctctggttgggagaaagccgcccgcatggacagtctgggcgaaggatatggattggaagatttgcgggcagttctcttagggaagaaagcacataccccgcgaaagaaaacagtcacacaggcagagccgccgaaggtcaatctgctggtggacattcaggcaaaattgcaggctggaaaaggtgctggctatgcgcgatgggctaaagttttcaatctgaagcaaatggcgcagaccatgaattacctgtcagagaataacctgctggagtatgcggttttggaagaaaaggctgcggctgccacggcacatcacaatgaactttcggcgcacatcaaagcggctgaaaagcgcatggcagagattgctgttctgcgtactcacatcgtaaattatgccaagacccgtgaggtctatgtggcataccgcaaggcgggctactctaagaaattccgggaggcacatgaggaagaaatcctgctccaccaggctgctaagaatgcctttgatgagatgggcgtcaagaagctgccaaaggtcaaagagttacagacagagtacgcaaaattgctggaagaaaagaaaaagacttattccgagtatcggcgctcccgtgaagaaatgagggagcttttgactgcaaaagcaaatgtagatcgagtgctgaaaatggaggtagaacaggatgttgaaaaagaaaaagaccacggccagcggtaagctggttctggtcaaaagcgttcgcagaacgcgcagccacagaatgaaattctgtgttcaaaggggcttgggggcgctgccctcaacaagcaagcggagaggaaaatcacggagggattttcttctctgcgggcctgtgtgtattaacacaggcattgcttgcctcttttctccgaaaatgaaaagaaccagtgagagaatcgttaaatttcactcactggctcaattcgtttcaaatttttttgacaactctgtcagttctttcaccgtttcctgggtgtgatgcagcagggtgtcacgcatttctggcggacagctggaataaagcattttcatctgattgacaccttcatcctccagagaaacatctggatttataagtgtatctaaagagatatgcaggaccttggccaatgctctcaaaatcaaataagaaggattcattttccccttttcgatattggcgatttgctttacagaaacatggctcaaatcagatagctcctgttgtgttagctctttattctttcgggcttcccgcattttctgccctaaagcagttaaatcatcaatcggcataatcgttcacctcaataacattgtatcgttctagtttgtgcaaaggaataacctaattatgcctgatgaacggtaagattatgctgatttttgtagagtaataggtagggataaacttgtattcttcgagaagacgaaatataatattttaggaggtgcaaaatggactacataacattaaaagaggcaagccaaaaatggaatgttacgccgcgccagataaattatttgtgtacatctgggcgcatccccggtgctgtaaaaatggcgacgatttggcttattcctaaaaatgcagagaagccagtagacaggcggagaaaagaaaacaaatctcagtgaggtttctgtgacatttgggtgatacactgaaaatgaaggagtgtgataccatgcgaattttagtagtcgaggatgatcgacttttgaataatactttatgctataacttgaatactgcgggctatgcggttgattctgcgctgacaaaatcagcggccggtagtttcttgacagagcaggactatgacctaattgtgctggatgtaaatttgccggatgggaacggttttgacttctgccgggaggtaaaagaacgccgtcccgataccgctattatctttctgaccgcaaatgatatggaaagcgatatgctcaaagggtatgagctgggtgcagaagattatgtgacaaaacctttccctatgagtgtctttcaaaagaaactggcggtagtgctagggaggctgacaaaacaatatggtggtgatacttatgaggatgacatactgaccatcaatttttcagaaatgagtgctactctatcaggaaagccacttacattcacaccactggaatatcgacttttgaaaattctgatgaaaaatccacagattgttttgacccggcaagtcttgttggaaaaattgtgggacgcagacggaaatttcgtggatgaacacgctctgactgcggctatcagccgggtacgaaacaaaattgaaacacccgaccgtcagtacatcaaaacggtatatggtatgggttatatgtggattggaggggtgctgaaatgaatgggcgaaaactctctgtcaacaaagcctgtctctttttagctgttctcctgctggtggcaatggggacggtttcagcagctttgtatgggctaactcagaatataaccgctgtctggtatgtagtattgttcggcatctttgtgctgctttgcgctgtttgttttatggtgctggttcggcgtaaactggcaatgttctccgatagcttttgtagtctgatagataatatgttgtccggaaatatgcagccgaaacagattattgaagaagaaagtcttttctataaaattgaatatcggctgaaccgtttatatgaagtcatgcaggaaaacaagaacagcattgcacaagaacgggctgacctgcaagaactgatttccgacatttctcatcaggtcaagaccccgattgcgaacttgaaaatgattaacagcaccctgcttgaaaatgaagtccctgtgcaaaagcaaaaagagtttcttacagcacaggccagccaacttgataaactggattttctcatgcagatgatgattaaaacctctcgtctggaagcaggtgtcatttctctggaaaagaaaagccagccgctttatgacacgcttgccgccgcattgggcggtattcttctgaacgccgagaaaaaacagatcaatgttcaagtggactgcccggagaacttggtcgtttcccatgacagaaaatggacaggtgaagcattgttcaatattttggacaatgcggtgaaatatacgccggagggcggtcaaatccgtgtttcggttgaaagttgggaaatgtatgtgaaaatcgacattgcagatacaggcattgacatttcagaacagcatcagggagcaattttcaagcgtttctatcgagaggacatcgtacatgatgtagatggaattggtattggtctatatctggctcgtgagatcgtaaccttgcaaggcggttatatccgggtaacatccgaggttgggaggggttcaactttttccgtctttctgcctcgacaataaaataagtacgctaaaaaacaaaatgtcacagacctatgacatttgagatttaattaaacagaggtattttgtttcccgtgacatttctgtgaggtttaccttttatgatagagccatcaaaaagaaagggtggtgttctatatgaacatattacaaacgacagatttgaagaaatattacggcaccgaaccgaacattacaaaagcattggatggcgtgaccctatccattgaggaaggtgaatttgttgccattgttggtacttccggcagcggtaagtctactttgctgaacatgatgggcgggttagatacgccaacttccggcagtattaaagtaaaagggaaagaattatcgaaactcaaggatgaacagcttaccatcttccgcagacgtaacatcgggtttatctttcagaattacaatcttgttcctgtgctgaatgtctatgaaaatattgtcctgccggtggagctggatggtgataccgtggacaagcggtttatggatgaagtagtgaaaatgctggctctcgatgggaagctgaacagtatgcctaacaatctgtccggcggccagcagcagcgtgtagcgattgcccgcgcccttgtttccaaaccagctattatacttgcagatgaaccgacaggcaatttggatagccggacaagtagtgatgttcttggtttgctgaaagttacaagtcagaagttccatcaaacgcttgtaatgattacccataacaatgaaattgcccagcttgccgaccgaattatccgtattgaggacggaaaaatcgcacagtgacagggggtgacattgatggatgatattttatttgggaacaataatcaggcaacaatcaatcgtcttgccaaaagaagctaccgcgctaataagcagagaaatgttttcgttaccatcgcattattcttgaccgcctttatgattacatctgtatttagtttggggtgcagttattttgaaacctatcaaatgcagcaaattcgtgcgatgggcacgactgcggatgtggcaattacaagtctctcagaagaacaatatgaagaattgagccgatccagcttggtatccgtagttggtgtcagtcagagattgggcagcattgatacatctggaatggacgatgccctgctgagtattacttggatagacgaaacagaatggcaagaacaccgtgtaccaacaatttcggatatacacggagattatccgcaagcaaaaaatgaaattatgctccctacatgggctttgcgtgcaatggggattgatgatccacagatagggatgaatatttccctttcctatcaactcggaacagattatcaatatatctccgatgaatttgttttgtcgggctattatacagattattcggcttcacgtgcaggcaaccgtggtgccgcttatgtttcggagctttttgcaacacaaacagggcttccctttgatagtgtgtctaccgcaatgatttctttttctgatgacagtaatgccctgcgatcctgtgaaaaactaaaacggaagatttcgtttacagaaagtcagtcctttgaaattgtacctattgctcagagcaattccaccaccattgttcttccactggctgctattatcgtctttatcattatcagcggctatttgctgatttataacattctgtatatctcaatttcaagagatacacaattctatggacagcttaaaacgataggcacgacaaaaagacaaatcaagcggatcgtgcgttctcaaatattcagaacggcggtgatcggtattcccagcggcctgattgtcggtggtattgtttcgcttggacttgttccgtttgccatgaatatgatgtactcaagcgatacagaccttggggagatagtgtccttttcccccattatttttgcgggtgccgcaatcttcacattttttactgcaatcatcggcagcatgaaaccagcgaaaatagctgcaagtatttctcctgttgcggcttcacgctatacggaggcaaatacaaggagttaccgagatcataagagccatagaacaaaattatctcggatggcacgagataatatttttagaaaccctaaaagcgctttccttacttttgcgtccttatttttaggcttaatattgtttttggtttctgctggtctactatcaagcctaagtcccgacaattttgtaaatcaatggggagaaagtgatttcgcattgacttacagcatttccgaagaaggaaacctgctctctgatgaaatgttgcagcaaattgaaacaatgcagggaattgaaaatctgcgcgtcacttattctgcttcaccgtggcccactatggatgtcatttacgacgaaaatgtattcgggaaatatattgattccttggatggcgtatcaggtcttgatttttcaaatgcggaaacacgaaaaaactatacagataatttttggagcggcgtttacggaatagattccagatatatcgaagaacttaataaaacgcttgataagcctattgacttaaccgcctttgaaaagggagagttggtggttttgtccgctatgacggatgatgagggaaacctattgattcagccagggcaagcaatcaccgttgtcggtgagtccggggaacaggtctttacagtggcaactggctttctggacgctgattttcagagtggtcgaggaaatgagagaggtactgcccctgatttgtatatcagtaagcaggcaatagagaagttgtctggagaaaccaaaatctttcggattgcttttgacacgattgatagcagttatgacaaagggattatggagcagcttcaatccattactgcttcgtcaccgggcattacgattctgtcacgatatgaaaagcagcaagaaatggccggatatttgctgacctcaaggattatagccgcagggttgtccgctgtatttttgctgataggaattatgaatttcattaacacaatggttgttagtgtaaatactcggaaacatgaatttgcaacacttgaaagtataggaatgacgaaaaagcaaattagaaatgtattgctttgggaaggcgtgtattattggagtatttctttcctactgcttgccacactgggaacagcgatatatattccaatatactcagcctttagaagaatggttccttatgcagcttttcactatcctgtaatttctctgttggttgtcgcagctattgttttgctggtctgcttggcaacccccgtcataactttcatgcaaaatgttaagcaaagcgttgtagagagactgcggcagaattaaatatttgcgatgaaaaccgggagattattctcccggtttttcaaatctcacaggttcgtgagatttcagcccattattctgtcgaaacagcgtgtgtcagtgacatttctgtgaggattgcttgttaagataagcgcaaaaggaacaagctgccgcacgacggcaaaagaaaaaaagccgtcgtacagcagcctatcaacacgcccatttgaaacggcggctttgattttcagagccgccgtttctttgcgattgcacaaaccaatgacgacttgcagggacacggtagccgattggaggttaatttaccgtgtcccgtttgctttttcaaagctcacatgatctacatcagttaaaaaaagcattgctcctcctccgggcaagtataatattgtatcggcattatcgttctatgtaattcggtataataatggctgttcttggcgcgccagttttcccccacggaaatctggcgttttttgttgccattttttcggagatgacccggttgtctgccggtgtcggtctccacctccattcgattcacccgtcaatcacccgtgaatcgaaatggaggtacataatgaagaaaattaaccttcgggaactttatcctgatgtttatacaacagacttttttgtagatgtgacagaggaagtaatggagactattcgagcagctgaacgtgcggaggctgcgtatgagcgaaagatgtatcgttataaagcacagtattctctggattgcgagaatggcattgaaaatgcggtgttgttgaagccgcagacaccggagatggttctggaggaaaaacagtttcaggagcaggtctatgccgctgtgatgaagctgccggagaaacaggcaaagaggatttatgccagatactatctgggaatgacggtaaataaaattgccgaagtagaaggtgtagacccaagccgtgtccgagacagtatccgccgtggattaaagcagcttgtaaaatatttttgataaaatttcatttgatacgcctgttttttgccttttttgtcagtgttaataagaaggacaagttttcctccttcatcagtacattgacaatcgaatagacagcacaacaggtacataacccatgtacgagcgaatatgaaacgccgcgaagatggagcagtcagggaggtgatgaaagaactgcttcggagcgatctacgatttcataaaacggattgtggcagattcggcgcgatgactgcatgggggcttaaagatacttcctcacggcccgccaaagacttggggggaaccctgcggcgcacgagtaaaacgacgccgcggagttatgacaaccgcgccagcggagacctgttatgttcccatcgtcagggttgcgtggcaaatgtgacgagaattgagtcatattgaaataggaagcgactgctcttttgggtggccgctttctattcaaaatcagataccatgcgctggcagtttcggctgccagcgtattcatgtgattttgaaagcacgatgataaccttgacagattggagggaatatagtctatggaaaagctcattacacgaaaagaagctgctgaaatcttaggaatcagcatagcaacgctggatgccgcccgtaacaacggcttgatctcttatgtgcagtatgttcagaatggctgtgtgtattttactgcggcaggtctccaggagtatatcgcaaaatgcacgcacagagcaaaaccagttgagagaagcgcaacttaccgtaaacctcgaagcggaagatcgtgagccggtccgtatccttgatggaatcagagaggtctgataaaacaaaggtacagcgctggagattattcttaggaggtggaggaattggcaaatagaaaaataatacttcctcaatatggcacagtcatgaaaagaggtgtcctatattataggaccagaatcaaagacgcgaatggtaagctcgtagctatctacgcaaaaacacctgaagaactatataacaaagaaacgcttgcgttggaacagattgagaatgctacttttcatcggaaaacgcccacagttgcagagtattgtgaaaagtggctgctgatgcagtcggttcatgtacgagccactaccttgacggattacacatcaaaggtcaggcggcatattatagcggaattgggagataaacggatgggagaggttagtctggatgatattcaacttgcccttgttccggtttccaagaaatctgcatcggtttataaatctgtggtgatcctttacaagtctatctttcgcgcagcgatggaaagcaggatcattgaccataacccaacgatttatctgacaacaaaaggtggcggtgttcctcaagaggagcgtcaggctttgacagatgaacaggtggagcgacttttggatgctatccgagatttgccgccttatgtctttgtcatgattggtttgtatgcgggtctgcgccgggaagaaattcttgctctgcaatgggattcagtatatctggatacggatactccatatctgacggtaaggcgggcatggcatacagaacacaacagaccggtgatttcggatgaattgaaaaccaaggctgcggagagaaatatcccccttcctgtttgcttggctgagtgtttgaaagcagcaaaggaaacttcgacttcggagtacgtggtttcaaaccgggatggcgaaccgctgtcctacacgcagtttaagcgactttggcagtatattgttacgaggacggtcaaggagcggagctattatcggtatgaagatggaaaaagagtaaagcatactgtcacacctgtcttgggagaaaaggctgctcataacggaaaagtggtttacagtctggactttgaagtaacaccccatcagctgcggcatacttacattaccaatctcattcatgcatcggtagatcccaaaacggttcaatacctggcaggccatgaaagcagcaagattaccatggacatttatgcaaaggttaagtacaacagaccagatgagctggtcagatcaatgaactgtgcgtttgcaagctgggatgcagcacagtaataacaaataggaaatgaagaaggagcgaggcaaggatgtctcgctctttgttttacctcagccgtatctttgattaaatcggggctttctgataaaaagagagtgtagatacggagactacacattatcaagaaaggacgatcaaagatggcaaaaaagaaaacacagatcccgaagtacgggaccattacattgaaaggaatccagtattacagaaccaggattacggatgcagatggcaaagagttgagtttgtatgccgcaacttgtgaagaattgtatgagaagcagttagaggcccggaagcaggtggaagaaattatctttcaccggcagcacccgacagtagccgagtatggcgagaagtggctgctgatgcagtcggcaaaggtgtctgcgtctacactcagaggttatacgagggatatgacaaactatatcatcaaacctctgggagagatgtatatggaagaagtgactgctgacgatattcggctggcgcttgttccattgtcaaagaaatcggaaggcttatacaataaggtcaatatgctactcaagtgcattttttatgcggcagagagaaaccaaattcttgaacacaatccctgtgcgggaatatccggtaaaggcggaaaaccgacaaaaaagaaggaggcattgacagatcagcaggtagccgtgcttctggatacagtcaagggacttcctccatatttgtttattatgctcggtttgtattccggtctgcgtcgggaagaaattcttgcactgcaatgggattgtgtatttctggacgaggatacaccttatctatcggtgaggcgggcatggcgtacagagcataacagacccgtgatttctacggtgctaaagactccggcggcaaaaagggatattccgataccgaagtgtttggtggattgtctgagagaaacgaaagaaaattccatatcagattatgtgattgctgacagcaaaggggagccgctggctgcttcgcagtttcaaagagtgtggcagtatgtcgttgtccgctccactaagccccggaactattataagtatgtgaatgggcagagcatcaaatacacggttaccccaacgctgggcatgacccagaaaaatcaacccaaaatcagatatacgctggactttgatgtaaccccgcatcagctgcggcacacttacattaccaatcttctctatgctggtgttgatccaaagaccgtccaataccttgccggacacgaaaacagcaaaacaactatggacatctatgcaaaagtgaagtacaataaaccagaggagctgtttggggtagtaaatggtgcgtttcatcaggctattgctgaatgaaaaaatgccgttttttatggtccgcacaccggataactgagaggcagaaagccggaaaatcccggagtatcaagggaaaacagctcaaaaactcgcgcagtatggtctcaaagcagctcgtagagcaccacagttctctaaacgttaatttggagcaatgtggctgcaggaaagacgaagttttttcgagttcattttcaaaaatacaaacctcagaaaccttgtgtttctggggttttttgtctgtttatattgaaagaacaccaatttccacatataataaaagacaatgtgtaaagaaatgaatcagggagaataataaaatatgagtatattaaatgtagaacatctgacacacggttttggtgaccgtgtcatttttgatgatgtatcgttccgtcttttaaaaggggagcacatcggtcttgtaggagcaaacggagagggtaaatctacctttatgagtatcgttaccgggaaacttacgccggacgagggaaaggtggaatgggcgaagaatgtacgagcaggctatctggaccaacatgcagtccttcagagcggtatgacgatccaggacgcactgaaaagtgcgtttgatccgcttttgcagaaggagcagcgaatgaacgagatctgtgagaaactcggtgaagtagacgaggatgagatgaatcttctgatggaagagcttggaacgatccaggatgagttgacactgcatgatttttacacgattgatgcaaaggtagaggaagttgcaagggcactgggacttctggatctgggacttgaccgtgatgttacagatctaagcggaggtcagagaacgaaggttcttctggcaaagcttctgcttgagaagccggacatcctgcttctggatgaaccgacaaactatctggatgaagagcatattacgtggctgaagcggtatctgcaggattatgagaatgcattcattctgatttcccatgatattccgttcctgaatgaagtggtaaatatcatctatcatatggagaaccaggaactgaatcgttatgtgggagactatgatcattttcaggaggtctatgcagttaagaaagcacagcttgaggcagcataccgcagacagcagcaggaaatcagtgaactgaaggattttgtggcaagaaataaagcccgtgtttctacaagaaatatggcgatgtccagacagaaaaagctggataaaatggatgtaattgagctggcagcggaaaagccgaaaccggaatttaagttccgttacggacggactccggggaaaatgttattcgaaacaaaggatcttgtaatcggttatgatgaaccactttccaagccgctgaatttccagatggaaagaggacacaagattgcgattgtcggaacaaatggtatcggaaagactacatttttgaagagtgtacttgatctgatcccggcaatttccggcgagtgtgagcttggggaaaatcttcagatcggctattttgaacaggaagttaaaggagaaaacaagacaacctgtattgaagagctgtggcaggaatttccgtcatttacccagtatgaggtgcgttctgcccttgcaaaatgcggactcactacgaagcatattgagagccaggtaagggtactgagtggtggtgaacaggcaaaggtaagactctgtaagctggtcaacaaggacacgaatctgctgatcctggatgagccgaccaatcatctagacgtggatgcaaaggattctctgaaaaaagcgcttcaggaatacaaaggaagtattcttctgatttgccatgagccggaattctatcaggatgtggtaaatgaggtgtgggatatgagcaagtggacgatgaaagtattttaaaagtgtcgtgcagaagacctttcgggactatcctgaaaggcctttttgtgttactatttattcagaacgtatcattttagtcattactttttattttataggaaattccgaaggaacttcctatgaaataaaaggcactacgtgccggagatgcgcactcgcacgaagatgaagaatgtcgcaagcgactgcgctcggcgcgagaatgtgccaaggcacattcttttttacaaagccgttatataagctttacagaagtaagatagagcctgcaaagcgcaacgtctataataaaacgtgtttcagaaaagaaaggatgggataatatgccgtcaacttatgcacattacatttttggacagcagatcaggggcagattaagcggatatgagagaaaaattattgataaatatccggagctttttaatattggacttcatggaccggatattcttttttattacagaccgcttggcaagaacaaggtcaatcagttgggaagccgtatacataacgagagcggggcaaagttcttcgttcatgcagcgaaggctttacatacacacgaccagtatgagaagcatctggcttatgtatatggagtgctctgccacttcgcgttggatgaaatctgtcatggttacgtggaacaggcagtaaaagagactggtcttgcacatattgcagtggagggcgagctggatcgtaagctgatgattatgaacggagaaaatccagtgagcaggagactgaccggacatattgttccttctatgaaaaatgcgataattataaaagatttttatcgcggaattacagcaaaggaagtcaaaaaagcactgaatggaatggtattttatgacaggattcttgtctgtccatctaaaataaagcggatggcactttatgcagcacttaaagtggcagggctttattatgattttcatgggtttattatcaagtatcatgagaatgaatcctgcagggaacagataagaaaactgcttcatctttatgaaaaagcagttccactggcagacaaactgatctgcgaatacaaaccgtttctggaaggaaacgccacattagattctgtatatgcctatacatttggttctcagtttcctggcaaggaggatacgttaaatgaaaataaaattgacaaaacaggagaaaaactggatactttatgatgtcggaaattctgcattcacacttctggcagcaaccattttaccgatttatttcaactatatcgcaggaaagcagggactttcggatgtacagtatctggcatactggggatatgcagtatccattgcaaccttacttacagcacttgcaggaccggtatttggaaccgttgcagatacaaaaggctataaaaaaccagtttttacaattgcacttggaatcggggcaattgcttcagtcgcactgggatttgcaaagtactggctggcctttctggtagtttttgtcattgcaaaggtcggatattccgtgacgctggtattttatgattccatgcttgtcgatgtgacattggaagaccggatggatgaagtctcttcccagggctatgcgtggggatatatcggaagctgtgtaccgtttgtaatctgtcttctggttgtgttaaatgcagggaagattgggattacaatggagatagcaatgatggtttcctttgtgatcatcacggtatggtgggtaattatgacattaccacttctgaaaacttatcaccagaagtattatgtagaaaagaagcagcatgctttttcagaaagcttcaaaagaatcggcattactctgaaaaatgtaaagaaggagaagaaggtttttctgtttcttctggcgtttttcttttatattgacggggtttatacgattattgatatggcaactgcatatggatcagcacttggacttagcagtacaggacttcttcttgcattgttgcttacgcagattgtagctttcccatttgcgattattttcggaagacttgcgaagaaatattctgcagaaaagctgatcacagtatgtatcgtggcataccttggagtggcaatttttgcgatttttctgcattaccagtggcagttttgggttcttgctgtctgggtaggcatgttccagggaggtgtgcaggcgctttcaagatcttactttacgaaaattataccggcgaaccagtcaggtgaatttttcggcttaatggatatttgcggaaaaggcgcgtcctttatgggaacaacgatcgtgagcctgatctcgcagcttaccggcaatatcaatattggtgtggggatgatcgctgtcttatttgtgatcggaattattctattccggagagcggcagcgctagaataaaaataaaggatacaatagatttatgatgacagagcttgaaaaatattataacaaattcaacgaagagaagcggcttaagagccgccatggacaggtagaatttatcacctcaatgaagtacattcacaaatatcttcctaagcgggagcatggacaggtaaagattctggatgtaggagccggaaccgggcgctacagtgttgcgcttgccgaagaagggtacgatgtgacggcggtagagctggtgaaatacaatctgggaattctgaaaaagaagaacagctctgtgaaagcatatcagggaaatgcgctgaagctgtcacgttttccggataaggaatttgacctgatcatcctgtttggaccgatgtatcacctttatacaaaggaagataaggtaaaggcgctgatggaggcgaagcgtgttctgaaagatgagggcacgatcctggtggcttatacaatgaatgagtacagtgttctggtgtatggattccgggagaaccatatacaggaatgcctggaaaatggaaaactggatgcgaattaccgggtatgtccttcaccggaagatttgtatgattatgtgcgtctggaggatattgacagctacaatgaagcagcaggaatggaacggctccagattatttcggcggatgggccatccgattatatgcgtcaggtgttaaatacgatggatgaaaagactttccagacgtttattgactatcatctgactacgtgtgaacgcccggaactggttggtgcgggatcacatacggtagatattataagaaagaaaaagatgggggaatagaaaatgaaagtagcagatatgcattgtgatacaattttagcgattcagagaggaagggaacagggaaaagagatttcacttcggaaaaataatttaaatgtggatcttgaacggatgaaaaagggggattatctgattcagaattttgccatttttctggatctggaggatccgatgcttgcaggaagtccatttcgttatgcaatgaaaatggcggatgtattttatcgggaaatggagaaaaataaagactggatccggccggtcacaaagtatgacgagattgaagaaaaccggaagaatggaaagatgtcggcgttgctgacattggaagaaggagaaatctgcgagggcgatccttcccttttaagagacttttaccggatgggggcaaggatgatgactctgacctggaactatccgaatcagcttggatatccggcaaaagcgactggcggagaatttgccggaaaagtcttttcagaagccggatatgggcttacagcgcgtggaattgagtttctggaagagatggagaacctgggaatgatcatcgatgtggcacatttaaacgatgcaggaatccgggatgtattaaagttcacaaagaagccttttgtagcgagccattccaacgcgagacatttgtgcagtcatccgagaaacctgaatgatgaacttctgaaagcgatcggggaaagaggcggtgtgatcgggctgaattattatgcatatttcctgcgcgactggaaagacggagagacggttgtgagcagagcggaggatattgtggcacatgcaaaatatatccgtgatatggcgggaatagaggctttaggacttggttcggactttgatggtatgaatggagaactggagatcgcatcccctgtagatatgacaaagctggaagatgtatttaaaaagaatggatttacagagagcgagattgagaaaatcttctgtaagaatgtaatgcgaatatatagagaactgcttgggtaattccggcaaagcatatttataacatagaaaacccggctgtggagtaatacacaagccgggttttttactctagcatcttttgcagcgattacgcaactgttacattaacagcctgaagtccgcggtttccttctgtgatatcgaaagtaacgttctgtccttcttcaagagatttgtatccttctcccgcgattcctgaaaaatgtacgaatacatcttctccggtgctttcgtttgtgatgaatccgtagcctttctgtgcgttgaaccacttaactgtacccttgttcattagtagtacctcctaaaaaattgatgatgccgataaaaataaaaatcacatatttttgtaagtcatcagacagatgttaatgatttacaaaaatatgtgaaatctaaatcttatctaaaacacaatttcagaatatcacgtggtaggacaaatgtcaaatcaaaataggaaaaataggaaaaaataaatgtctttttattgacaggaagaaaaaggaatgctattatttttaacatatttaaagagtgaaaatatttgtacaaagaggtactttactgcggagaagaacgcagagagtatcttttttttgacttgcaggagtgcaaagcacgtagcaatctggtatcaaaggggtcaaaagtataaatgggatgtcagaaagaggtagtgcagatgaaaaatcatgaactggatgcagtggatcgtacaattttgaatattttacagagaaatgccaaatgtccattgaaagagattgcagagaaggtgtatctgtctacaccggctgtatcagcgcggattgaaaagatggaaaaagaaggatatattctcggttatcaggcacaggtgaatccggaagcacttggatatcatatcaaggcactgatcaatctggaggtttcgccggaggaaaaaaatgtgttttatccgtttgtgagaaagtgttcaaatgtgatcgaatgcaactgtgtgaccggagaatattctatggtgttggaagtactgtttcccagcacaacagagctggataaatttattggagaattgcagcgatttggaagaacaaagacactgatcgtattttcaacttcggttgaacacagaggaatcaatgcagatatagaagaaacactggagtgagaaatataatttcccgtaaattgaaaaagacccggaaacaaaagttttcgagtctttttcttctttaagggctatataaacaagcagtttgaaatagtcattttgattattcagcagcgatagcaacttccggaacaattgtttcagtagctttttcagatgctttgatatctgcaggtgtttttgcaaaacctttaaacacgatagaaccaacaaatccagctaaagatccgccgatcgcagcaagtacgattgcagctacaaccttaagtggtgggttgaatccgaatggagctaaaagtccaggaatcggagatgctgttccaggggcgttattgataataccgagcatagctgctgcgagtccggcaagtccgccgccaaagaagtttgatccgtaaatcggaatcggattctgtgtaataatatcggcctgtgtaagaggttcaagcattaccgcgataacattactgcgctcgccaagttttaaacggtcgaaaatgataccgtttgtgaaagaaccaccaacacatgcaattgctgcaatacccattgcaagtccatcaagtccgagcatagcagtcagagccatagaactaagtggtgaggtacagatcatcttcataataccaccgagcaggaatcccatgataattggagactgttcagcagctgcagaaatcatacgtccgatgttgagcagtgttgaattaacgaccggatcaactgcgatggcaataattcttgcaagcggtgcgattgcaagagcaccaacgatcagattcagaccctctggaagtttcttttccaggaacggagctacaaaacctacaatataacctgctacaaaaccaggaagaattccgtatcctccgactgcgacacctgcaacgactgcaagtaccggattacatcccatactgatcggaactaaagtagctgcagcgattcccccgaagctgccggatacggttccgagttctgagaaaaatgcaattcctaataaatcacctgtgatgtaatggtgaacagcttctaccaggaacgaagcaacggctgcattagccattccggacattgcttctgatccttttggaaacttcaggctgaatacagagaaacaggctaaagtgagaagcagtaaaccaataccttttacgattgttaacatatgacatcctccttaaaatttatacttattcgcatcagttatcgtgataacataataaaatggaagttacaaaaagatacaaaaagtatcaaaatgaaatttatttttggaaaaaactacaaatacgggatagatttattgtatataatgacgataactataagtgataatgaattatagagaaaacatataaagagatgaaataagaagcaggagagaacctgaaaatcaggctctctcggtgcattcctgaatcagtgcattcaggaaatttttaattttcacattgccgtgccgtacactttttccacggatgaaatccatttcccttcggacctgttcaaagttatacagggagttggagtaggttgtaaacgtgtcattggcgtaatcttcaagaccaaggttggcaaggttgaccattcccatgttggctgtccgacggatcctttgttccatggattttggattgtcactgaaccgactgcaaagttcgcttaaagtgacattgtcaactttctggttatgttggatcagataatcgacaagggaaatgatatccttgctgccacgttcaccggtgatgccaagcttttggagaattccttttaaccggataatataaggtttttcagccgtatcatttataaatccctgtggctgtacaaaattctgctgggtctggaaaatcgtctgcacctgctgcaatgtccggcgggcagtcagggattcactgaccttccggagtatggattctacttcgatactgttgattggcttatgaatataaaattcaatgcctgcagaataggcatctgcgatcatatctttggatgcaacctgggaaagcataataaaagtaagattcggtgcatgagagcgggcacgtttcacgaaagtgattccgtctatttccggcatcagaagatcaacaattacgatgtctggatttataagaggaagatccgtgagtgcatccacaccgttttcggcagttccggcaatctctccaagtccacggtcccgtataatacgttttaatatatgcagtacatttttatcatcatcaatgagatagaatttcatttataaaccgctccatttctcttttggtatagtaagtgtgaaaactgtttttccgggaacggaagttacccggatggttccgcccaggcggagttcgataaaatcctttaccaggctaagtccaagtccccgattgacctcgccggtttcgtaattgatctttgtggaaaaacccggttcaaaaatttgttccatatcctccggatcaattccgggtccatgatcttcaacttcaataacataagaagaatccgtggaggattgacggacagaaagctcgaccggatttccgtctgctgcttcaatcgcattgttgaaaagattgcggaagattgagagcagaagataatggttctgtgtatatagattttcctccagttgtatattaaaaaaaagtcgtttcccttttggaagtgatgcatccaggctgcttttcagaatggtgaggatatcatccaggctcattccgtcattttcagaatttaattccattgaagaggaaagtcctcttacaatcagattgtagtcttttttgatctcgtggacatcacgtgcaatctgaagtgcggtgcgggtgagggattcgtctatattccgttcactcatatcgtggtaaagccggtatgcggtgctcatggtgtcctctatcatacgtgtacctttctgcatcagaacaacttcgccgttaagctcagaaatcaaaagaagaaggttctggtatctccgtgcatgttcagcactcaggagactgaacttgtaatggctgagacagaacaggaaaagacccgcaagtgcagtacgcagaagcgcaaccagaaggacacctgcctgggactgaaaagaaaaagcgtccatatccatacgggtcagcagttctgttatatttgccagatagtcaaaaagaaacatccagggcagagaatacatcgaaagttcatagtcatttttacggcagtagagaaaaaaaaggattccgtagaccagatagaaaaacatttccggaaaatagttctgtggattccaactgccaaagcgaagccagtgcatcagtgtacgggaaaagaaaacacagagggcacttatcaccgtgaccggaagaatcggatattttccaaaaaggatcagagacatgaaaatgccaaaaattccgatggaaacacgaaaatcgctttcaaaaagtgagatgctgatctgggcgccaatgataacagcagcactgaccagcaaaatgtgggtataacgtgaaaaacttttggtccacataagaaagcctcctttattcagatcatctctcttacagtctacagtccggttaataattcaaccagaaatacgccggcacatgaaaacagggaaacacagatcagactttttctgttccatgcaaggatcagtgcgattgcaaaaccaatggcggcagaccagatattggcggtggctgtcagaatggccggaaaggtcataacagccagagttacataaggtacataatataaaaaagattttataaaagtatttttgatctctttcctgatcagcgtcagtggcagcatacggatcagataggtgacggctgccatgacaaagatatacatatatagattatgcttcaacggaagaatcctccttatcttctggatttgtttcttcttttacagggaagaaatacgctgcaattccggcaatcagaatcgtaaggataatgattcggaagccagaagaaatctggcatagcataggagcctttgtgaaaaggaagcttgctgccatggaaatcaagacaatggttccaatgatcctgttatcacgtgccggaggaataatgattgcgataaacattccatataatgcaacgctcagtgcgctgacgatccggtcaggcaggatatttcctgatactactccgaggaaagtgccaagtgtccagccaggtgcggcaagtgccatcacaccgtaagaataccatggagtaatccttccggggcgggatacggatacgccgaagacttcatccgttacactgtatgcgataagaaaacggtggaaaaaaggatagtggttatcaattttctgtgaaagggcacaggacatcagcgaatatctgagattgatgatgagctgggtgaatgccatttcaaaataggatgcggatgccgtaatcagtgaaagaccagcaaattgcccggcgctggtcaggtttgtaagggaaatcagaacagcttcccaagtggaaagtcctgcattttttgccatgataccaaaggtaaatgataccgcaatataaccgagacagatgggaatgccatcctgtatcccggctgcaaaatctatttttctgtttctactcatgaagtaaaacctctcttttgtaaataatccccaaatttgaattgttattttactaacattttaccatggaacagtggtcttgaaaatgatgttttaaaagaagttgaaaaaattttgcagaaagactggaaatatagtggtattatgagttataataaatagtgataaatgaatgtgcaaacataagtacaagttataaaaggagattgaagcatggaaatgttatctattgaaaaagaactgcagagcaattcttatcccggaagagggatcatcatcggaaagtctgccgacggaagcaaagcggtaacagcttattttatcatgggaagaagtgagaacagccgtaatcgtgtctttgtagaagagggagaaggaatccgcacacaggcatttgacgagtcaaagctgacagacccaagcttaattatctacgcaccggtgcgtgtactcggcaataagacgatcgttacaaacggagatcagactgatacaatttatgaaggtatggacagacagatgacgtttgaacagtcccttagaagccgtgaatttgaaccggatggaccaaactacacaccacgtatttccggtatcatgcacattgagaacggaaaatataactatgcaatgtccattttgaagagcaataacggaaatccggatgcatgcaaccgttacacctttgcatatgagaatccggtagccggagaaggacattttatccacacatacaagtgtgatggaaatccgcttccgagttttgaaggagaaccaaagcttgttgcaattccggatgatatggacacatttgcagacacactctggaacagtctgaatgcagataataaagtatctctgtttgtaagatatattgatattgagacaggaacatacgaaagcaagatcatcaataagaataaatagtatacaaaggtgaagaaggagcaggaatcatgaatgaattagaactcaaatatggatgtaacccgaatcagaagccgtcacgtatctatatgaaagacggaagtgatctcccgatcaaagttctgatgggccgtccgggatatatcaactttctggatgcatttaacggatggcagctggtatcggaattaaaaaaagcaaccggacttccggcagcaacttcctttaagcatgtgtcaccggcaggtgctgcagtcggactgccactggatgaaactcttgcaaaaatttactgggtagatgaccttggagaactttctccgcttgcaagtgcttatgcacgtgcaagaggcgcagaccgtatgtcttcattcggtgattttattgcgctttctgatgtctgcgatgttgatacggcaagactgatcaagagagaagtgtcggatggagtgatcgcacctggatatgaaccggaagcactggagattcttgcacagaaaaagaaaggtaattacaatgtgatccagatcgatccgaattatgttccggcacctacagaacacaaggatgtatttggtattacctttgagcagggaagaaatgaactgaagatcgatgatgatttcttctcaaatatagtgactgagaacaaagaaattccggatcacgcaaagagagatcttgcaatttccatgattactttaaaatatacacagtcaaattctgtatgctatgtaaaagacggacaggcaatcggaatcggagccggacagcagtcccgtatccactgtacccgtcttgcaggacagaaggcagataactggtggctgagacaatgcccgaaagtacttgctcttccatttaaagaaggaatcaagcgtgcagaccgggataatgcaattgatctgtatattggtgaagaatatatggacgtactggctgacggaacctgggaaaatattttcactgaaaaaccggaagtatttaccagagaagaaaagagagcatggcttgataagctgacgggtgtggcacttggatcagacgcattctttccgtttggagataacatcgaacgtgcacataagagcggtgttacatatattgcagaaccgggtggatcaatccgtgatgacaatgtaatcgatacctgcaacaaatacaacatggcgatggcatttaccggaatccgtttattccatcactaagataataaagaagcaaagttcctgcagaggtagaagatctacctttgcgggaattttttatttttaacagaaaatggagctttctattgtataaaaaagattctggaagaataatctgttgaaaaaataaacagatatgcgacaaatgtggaaaaatgtcgttaaaaaataaacagaaccgataatctgaagatttattatttagtaaaggattacataatatatatgtaacagccagcaggaggaggcgaatctatgggtattattgaaatccttttaatttcaatcgggctttcatttgatgtatttgttgtacatatctgtgttggagcaggattttcgaggaagcatggaaaagacacacttttatccagtctgatttttggaggaatgcagctctttgcactgatcctgggaaatgttgttgcagatattctgaagccggacagaaaaatgaatgagacgatttcaacagcagcaagtggatgggagcttttgtcggtgctgatatttatcggacttggcatttatatgatctgtaaagcaagaaataataagcagatctttgagcggagaaacgatgaaataaactggaaacggcttagaaaactggcagtacttaccagcgtagatgcgtattttgccggaatgggtatcggattctggagtgtggagatcctggaacagggaatggtattgcttccggttacgatcattcagtgctttcttggtgtggaggtcggatatagattgggctgtgaatataactgcaaagcttactggatcggtgggatattattcctgatcgccggggcagatatggtggttacgcattttttattttaaaatagcaggaggaaaagagtatgggcgaattgacacataaagcagcaagggcagcatttggcggagcaattgatttggcaatgcgaaaaatggataaagacagagaaaaaggtctgcttgatcttgttgatctgaccgagcgtttcatgggagataatttccagaagagctcctatgaaggcgcaagaaagatgatacaggatccggattcgaagtggatgagttatgtgaatcgtgcattagatgaaattgacccgcatgttattaaacagacagcattaaaccttggatttgaagcggcgttccatggaacgaagacaatccgcagtatgagagaggtacatcagtgcaatattccgtggctgatcctgatggatccgacaagtgcatgtaatcttcattgtaccggatgctgggcggcagaatatgggcataaactgaatcttacatatgaagagatggacagcatcattacgcagggaaaagaactggggatttatttctatatgtatacaggcggggaaccgttagtaagaaaaaaagatattatcagactttgtgaaaagcattatgactgcgaattccatgcatttacaaatggaacactggtggatgatgaattttgcgaagagatgagaagagtcggcaacctgtccctttcaattagtctggaaggatttgaagaggtcaatgacatgcgccgtggagagggtgtattcgacaaggttatggcagctatggatcggttaaagaaatatggactgatcttcggtacgtcaatctgttataccagaaagaacattgaaacggttacatcggatgaattcctggatatgatcatcggaaagggatgtcgtttcacctggtatttccattatatgccggttggaaatgatgcagcaccggatctgctcccgacaaaggaacagagagaatatatgtatcaccgggtaagagaaatccgcggtgcaacaggtggaaagccgatttatgcaatggatttccagaatgacggagaatttgtcggaggctgtatcgcaggtggaagaaactactgccatatcaatgcgaatggagatgtagaaccatgtgtatttattcactactcttctgcaaatattcgggaagtcactctgctggaagctctgaaacagccactctttatggcatacagagaccggcagccttttaatagcaatcatttgcgtccttgcccgatgcttgaaaatccggagattcttcaggaaatgatcaaagagaccggtgcaaaatcgaccgatctgcagtcaccggaaagtgcggaacatttgtgcagtaagtgcaaagcttatgcctgtgagtgggaaaaaacggcagatcaactatggaaagagcatccgcatcagcagaagggttacacaaattacaaaaaacgcgtggaaaagcagtaaaaaaacagaaaaaaagcggtttgaaaaagtgttttgtttgtgatagaatattcgtcaagagaaatgggcaggaaaaagaggacaacacatggaaagaaaaagagaattaacaaaaatcctgcttgcggaaagctttaaggaactactgataaaaggatcttttgataagataacgattaaaatgatcacagatcaggcgggagttattagaccgactttttataattactttcaggataagtatgaagtgatggaatggcttctggagacggaggtttttcagcatatccgtgagatgaccgaagacgggatggaaagagaagccatttatctgttgttccgaaagatggagaaagaccggatttattatcagaaagcatttgaagcaaccggtcagaatgggtttgaggaaattcttgaaaagaagatccgtcagctgatcgaagagatggtgggcagacataagatcaagcttgagaagcttcagggaataaaagacaaaaagatttttctggagttccatacgattaccgttgtaaccggactcaaatactggctgaccagccgggatattcatctgtcggcggatgaagcgatggagtattatctgttcctaatgtcgcatcctattttggagctgcttgaaaagtaaagaacaaaatataaatttgagaagaatctgggaaaatccgggttcttctttttgtttttctgtcagaaaattctgatagagcgttctgataaataaaagggaatacgttctggagaggtatattcttttgaaattgtagaaaataaaaaatgttatctaaactgcttgacggatttctattacagagttattatgaacatatgaacagttgctcatatgttcagtgagagaaaatttttcaggaggaaagaaagatgaagaaaaaatttaaaatggtagaccttgattgcgcaaactgtgcagcaaaaatggaagatgcaatcaaaaaaattgatggtgtaaatgatgcaacggtaagttttatgatgcagaagcttacgattgatgcagatgatgcaagatttgatgagatcatgcaggaagtcgttgctgtatgcaagaaggtagagccggactgccagattcagctgtaaaaccggaaaaggtatgaaaggggagaggcttctatgatgaaaaaacagaaaataatgctgtaccgtattatcgcagcggcagttatttatgttcctctttttgtactggaacatatgggaaaactggaatttcagtccgaaattccggtgcagtttttgttatttatgataccttatctgatcgtgggatgggacatcatttaccgggctgtgcgcaatatcagtcatggtcaggtatttgatgagaactttctgatgtgtatagcaacgtttggtgcacttggagtaaaggaatattcggaagcggtagcggttatgttgttctatcagatcggggagttattccagagttatgcagtcaaccgttcccgccagtcaatcagtgcaatgatggatatctgtccggaatatgcgaatattgaagaagacggaaagctcaaacaggttgatccggatgatgtagagattggtacagagatcgtcatcaaagcaggagagagagttcctctcgatggtgtggttgtatcgggaacatcctttgtagatacttctgcactgaccggagagtcggttccgcgagaagtaacagaaggttccgagattatcagcggttgtgtaaatggaagcggacttcttaaggtgcgcacaacgaaagagtttgatgattctacagttgcgaagattctggaactggttgaaaatgccagcagcaaaaaggcacatgtagagaacttcattacaaagtttgcaaaatactatacgccgatcgtggtttgtgcggcagttgtacttgcattccttccaccaatcattcttggcggtggatttgcagaatggattcagagagcatgtattttccttgtaatctcctgcccatgtgcactggtgatctctgttccacttggtttttttggaggaatcggagcagcatccaaacaaggcgttctggtaaagggaagcaattatctggaagcactctctgagatgaaaacgattgtatttgataagactggtacactgacaaaaggtgaattcgttgtatcagaagttattccgaacggatgggaaaaagaaggacttcttgaagtggcagcccttgcggaaggctattccgatcatccaatctcagcagcactcaagaaagcgtacgaagaagcggagcttggtgagttgtccatggacagggtggaacaggctgaagaaatcgccggacacggaatcaaggcaaagatcgacggaagagttgtctatgtcggaaatgcaaagctgatggaagaaaaaggcgtggaatatgagtcatgcacagtccctggtacggtcgtatatctggcggctgaaaaagaattcctcgggaccattgtaatttctgatacggtcaaaccggaagccaaacgtgcgatcgcgcagctcaaacaaagcggtgtcaaaaagacagttatgcttaccggtgacagaaaagatgtcggtgaagcagtagcagaaagccttggaatcgatgaagtctacacagatctccttccgggggataaggtagataaggttgaagcacttctcggagaactcggtgagaaagaaaagctcggttttgttggtgatggtatcaatgatgcaccggtactctccagagctgatatcggaatcgcaatgggaagcatgggatccgatgcagcaatcgaagccgcagatgttgttctgatggatgataatatccttaagatatcctccattatgagaattgcaggaaaaactctccagatcgtacatcagaatatcgtctttgccctcggtgtcaaagttctggtcctcatcctgggagccctcggcatggccaatatgtgggaagccgtctttgccgatgtaggagtatccgtaatcgcaatcctgaactccatgagaacactgaaagtaaaatagatgtcaaaagcataaagtaaaacaagaaagaattatccttaacgtgatggggataattcttttttgtttcataggaaattccaaaggaatttcctatgaaataaaaggcactgcgtgccggagatgcgcactcgcacgaagatgaagaatgtcgcaagcgaccgcgctcggcgcgagaatgtgccgaggcacattctttcttattgttatagaaaacgtactggggttactggtctggttctcaccaataaagtagaagggcaaagcagcagaaataaatgggataaattctattttgtgcaatggagatgaaactcaaaaatcgtggaagcctctgctgaacacgattttcgccctaagaggttcatcggaatggtttgcacaacttgaatttatcccatttatttctgctgctttgccacactaatttattctacttgcttttttgtcagcgacagtgtaaaatgacaaaacggattagaatagtgaaaccaagaagggagatacaagatggaactgtttatagatatactaaaagatacaacaattgacactgtgaaactgatacctttcctttttctgacatactttgcgatggaatatctggagaataaagccggtcagaagacggtgcggatgcttcttggagcagggaaaaaaggacctgtgatcggtgggatactgggcgttgttccgcagtgcggattttcggcagcagcagcaaatctgtattccggcggagtcatcacagttggaacgatgatcgctgtttttctgtctacatcagatgagatgcttccgattctgatctcagagcaggcggatgtccgtaagatcatggcaattttaatcggaaagattatcgttggtattgttgcagggattctggttgatatcggagtgcgggtgctaggcaaaggataccagagagggctgcacattcatgatatctgtgagcatgaccactgtcactgtgaagaaggaagcattgtaaaatcagcactcatccattcggtacagattctggtatttatatatgtaatttcttttgcgttaaatgcagttgtggagtggattggaatggaagaggtcatgaacgtggtgacgcattatccaattgccggaatttttctggctggtcttgtcggtctgattccgaactgcgcagcttctattacaattacgaaattttatcttgagggagtcttaaatgtcggcagtatgtttgccggacttttgtcatgtgccggaatcggactgatcgtactttttaagacgaaccatagttggaagaagaatgtgatgatcgtcacaacactttacggaatcagtgtagtgtgcggaattatagtggaaatcctgtttggaatgtagtacaatatccttatatgccgcagaagcctaaaaggaacgaaagaagtggatttgagatggctaaaaaaggatttattgcagaattcaaagagtttattgcaaggggaaatgtaatggatcttgcagtcggcgttattattggtggtgcattccagtcgattgtgaattctcttgtaaatgatatgatcatgccggtgatcagtcttctgactggtggggtcaatttttccaactgggtgatccggatcggatctggtgagaatgacacgatcaaatatggcaattttattacagcggtgatcaactttcttctgatggcacttgttattttttgttttgtaaaagtgatgaacaatcttgcttcaagaacagaaaagctgcttaagaaggaggaagaagcaccggcagcaccggctacgaagatctgcccgtactgcatgtcagaaatcccgatcgcggcaaccagatgtgcatactgtacatctgagcttccggctgaggatacggacaaagaagaataaagaaaagacaggaataatacgacagagaggaacataaaaacaatggagaaaattattttaacaggtgacagaccaaccggacggcttcatgtcggacattatgttggatccttaaagcgaagagtagaactgcagaattccggagaatatgacaagatctttatcatgatcgcagatgcacaggcactgactgataatgcagataacccggaaaaggtacgtcagaatattattgaggttgcactggattatctgtcatgcggactggatccggagaaatccacgattttcatccagtcacaggtaccggaactgacagaactttctttttattatatgaatctggttacggtatcccgtcttcagagaaacccaacggttaaatcggagatccagatgcgtaattttgaagcaagtattccggtaggattctttacttatccgatcagccaggcagcagatatcacagcatttaaggcaacgactgtaccggtaggtgaggatcagcttccgatgatcgaacagtgccgtgagatcgtacacaaattcaacagtgtatatggagaagcattggttatgccgaaagcgctgattccggagaacgaaagctgttgccgtcttcctggaacggatggaaaagcaaagatgagtaaatcccttggtaactgtatttatctgtctgattccgaggaagaagtaagacagaagatcatgggaatgtatacagatccgaatcatttgaaggtatctgatccgggacaggtagaaggaaattccgttttcacttatctggatgcattctgtacagatgaacattttgaaaaatatctgccggattataagaatctggatgaattgaaggatcattacagacgtggtggacttggtgacgttaaggttaagaaattcctgaatgcggttatgcaggaagagcttgcaccgatccgtgcaagaagaaaagaactggagaagaagattccggagatctacgagatccttcataaaggaagtattgaagctgaaaaagtggcagcacagactttaaaagaagtaaaagatgcgatgaagatcaactattttgaagatcagcagctgatccgggaacaggcagcaagatttgcagaataaagaaaggctttaagccggaggagagataataattatgggtaaatatttcggaacagatggattccgtggagaagctaatgtagtactgacagtagagcatgcgtttaaggtaggacgttatcttggctggtattacggacaggaacacaaggcaagaatcatgatcggtaaagataccagaagaagcagctatatgtttgaatatgcactggcggcaggacttactgcgtcaggagcagatgcatatcttcttcatgtgacgacaactccaagtgtgtcttacgtggtaagaaccgaagattttgactgcggaatcatgatttccgcaagccataacccgtactatgataatggaatcaaagtgatcaacagtaaaggtcagaagctggaagcagaagtagaagccaaagtggaagcttatattgatggggaatccggagaaattccgcttgctaaaaaagaggcgatcggaagaaccgtagattatgcagcaggaagaaaccgttatatcggacatttgatcagtctggcaacccgttcttttaaagaggtgaaagtcggactggattgttccaacggaagttcttcaagtattgccaaaagcgtatttgatgcacttggagcaaaaacttatgtgatcaataatgagccggatggaaccaatatcaacacaaactgcggctctacacatattaacgtgctccaggaatatgtaaaagaaaatggtctggatgtcggatttgcatacgatggagatgcggatcgctgcatcgctgttgatgagaatggaaatgttgttgacggggatctgatcctttatgtgtgtggcaaatatatgaaagaacatggtcagttaaaagacgataccatcgttactactatcatgtcgaatcttggactttataaagcatgcgacaagattggcatgaagtacgaaaagacacaggtcggcgacaaatatgtctatgagaacatggtcaagaatggattcatgctgggcggtgaacagtccggacatattattttcagtaagcatgcaacgacaggagatggtattctgacttctctgatgctgatggaagttatcatggagaccaaacagtccctcggacagctgacagaagaagtgaagatctatccacagcttctgaaaaatgtgcgtgtggcagataagaagacagcaagggagaatccggaagtggtcaaagcagtcgatgcagttgcagaagcacttggagatgacggaagaatccttgtccgtgaaagtggaacggaaccggtaatccgtgtcatggttgaagcggcgacggacgagctttgcgaaaagtatgtgactcaggtaatcgatgtgattgaaaaagaaggactcatcgtagaataaaaaatctgaaatagaatcgtgcagaaaaggatagcttgcagatgaaagtctgtgggccatccttttttagtttgcgaaccatagtctggatgtttgaaaaatattatttgaataataaagaaaaatgttctgccggtatagattttctatattttgacatgctattaaaaaaacatggaggaaaaagaaatggaggaaatgttttgttttcaatgccagcagaccgctcataacacgggctgcgaaggacatacaggtgtatgtgggaaaaagtcggatacagcaaatcttcaagatgaactgactggtgaactgatccggctggcaagggcagttacagaaaatgaaagaagcagatcttcggatgaactgatgttaaaagatctgtttaccacgattacaaatgtaaatttcaacagtgatacagtgaaaaaactgtcagatgagatcagagaagaagcagaaaacagaaaaccaggaaaagatgcttataatgtacagaagatctgggaggcatcggaagatatccgttcgttaaagtcattgatcttgtttggcttacgagggactgcggcatatgcttatcatgcatgggcactgggatatgtggatgcggagattatgaatttcttttataagggaatgaggattctgggagaagaaaaagggatggaagaactgcttccggtagtcatagaaacaggtaaaatcaacctgcactgcatggaacttctggataaagcaaacacggaaagctatggaaatccaattccgacagaagttccgcttacgatagaaaagggaccgtttattgtagtcagtggtcatgatctgcatgatatgaagctgcttctggagcagaccaaagataaaggaatcaatatttatacgcacagtgaaatgcttccggcacacggatatccaaaattaaaggaatatccgcatttgaaaggcaatttcggaacggcctggcagagtcagcaatttgagttccataatattcctgcgccaattttatttacgacaaattgtctgatgccagtcagacagagctatgcagaccgggtgtttacaacttcggtggtgtcttatccggagatggttcatattggtgcggacaaagattttacgccggttattgcaaaagcattggaatgcggtggatatccggaagatcatccgatgacagggattaatggaggaacaaccgtgatgaccggatttgcacacaacgcagttctggaaaatgcaggaaagatcgtggatttggtaaagcaggggaaaatcaggcatttctttctgatcggaggctgtgatggcgcagcaccaggacggagctactatacggaatttgcgaaaaagacaccgatggatacgatcatcctgacgctggcatgtggaaaatacagattgaatgatctgaggctcggagaaattgaggggattccaagaattttggatatgggacagtgtaatgatgcgtacagtgcgattaaagttgcaattgctcttgcagaagcgtttgagtgtgaggtaaatgaacttccactgtctatgatcctgtcatggtatgaacagaaagcggttgcgattctgctgacacttctggcgctcggaatcaaaaatatttatctgggtccgacgcttccggcgtttgtgtcaccgaatgttctgaattacctggtacaagagtatcagattaccccgatcagtacagtagatgaggatctgaagaatattttaggttgaagaggtttgaacgtgagagaaagaaatcggaaataagaaatgaaaagcattacttctgaaacggaaagcacaaaaaagtgtgagtaagaagaggtagtgcttttttacatactgtttcctttacaaaaagtgtcgtctgtgctaacataaatataacaatggcgatgccggtacaatagaaaaaaggagtgcgttttatgctgattgaaattgattttaacagtgatgaggcgatttatatacagctcaggaatcagatcattatgggaattgccacttcgacgattcatgaaggagatactttgccgtctgtgagacagctggcagataatatcggaatcaatatgcatacagtgaataaggcatacaatgtcctgcggcaggaaggttttcttcagcttgacagacgaagaggtgcggtgatctgtattgatgaagataagctggaagctttgcaggatctgaaagagcagcttcgggtacttctggcaaaaggaagttgcaaaaacattacgaaagaagaagttcatgaactggtagacgagatctatgcagattatgaacaaagatagattgaaaaaaggagactaaaattatatggcagaaaagcaatatacaaggcaggcgcaggaagcgctgaatatggcacggaagattgcagccgaactgaagcatccatatgttgggacagaacatcttcttttcgggcttaagagggtttttaccggagttgcagggcaggtgcttgataagaataaagtcgatgaagaacagatggaaaaagcaatggatatccttgtatctgctcctgaggcagctaagaaggaaagaaagcatctggagtacagtccgagacttcgatatattctggaagaaagccagaatgaggcagtgcagcttgcatctgaaaaagtcggaaccgaacatcttctgcttacaatgcttaaagatggagattgtgtggctacccgtatgttgatgaccctgaatgtaaatattcaaaaactttttcaggatcttctgcttgcggcgggaattgatccgaaagagtatatggaaaatcagaaggatggggaaactgttggcggaattatagaccagtacagtacggatctgacacaggaagcaagagaaggaaagctggatccggttattggacgtgaaaaagaaattgcacgtgtcatggagatcctgagcagacggaccaagaataatccgtgccttgtgggagagcctggagtcggtaagacagcaatcgtggaaggacttgcaagacagatcgcggaaggaattgttccggaaagcatgaaagataagcggatcatggtgctggatcttccggggatgattgcaggctccaagtatcgtggtgaatttgaagagcgcatgaaaaaactgatccgtgaggtaaagacggcgggtaatattatccttttcttagatgaacttcataccattatcggtgccggtggtgcagagggcgcgattgatgcatccaatattctgaaaccatctctggcaagaggggagatgcagctgatcggtgcaacaactcttacggaataccgcaagtatattgagaaggatgcagctctggaaagaagattccagccggttacggttgaagaaccgacagaagacgagtgtatccggatcctggaaggtctgaaagaaaaatatgaggctcatcatgatgtagagatcgaagaggatgcattgaaagcggcagtacatatgtcatgccgttatatcaatgaccgtttccttccggataaggcaattgatgtgttggatgaaagctgttcaaaagtaaaacttcgtggatttaaagtgccggagaatattgttgggacagaaatccgctgtggaaagctggagcaggaaaaagaagtggcgctgaaagcaggagatattgaaaaagcatcggagctccatagagaacagaaggaagcagaaaagaaattagagcaggcgaaaaagcgtttcaataaaaagaatgaaaagaaaaaagttccggtaactgaagaagatgttgcggatgtaatttccatgtggacacgaatcccggtaacaagactgaatgaatctgagagcgaacgcctgaaaaagctggataaaacactggagaagcgtgtgattggtcaggaagaggcaatccaggcactttccaaagcggtaaaacgaggaagagtgggattgaaagatccggcacgtccgattggttcattcttattccttggtcctacaggtgtcggaaagacagagctttccaaagctcttgcagaagcactctttggcaatgaagaggatatgatccgggtagatatgtccgaatatatggagaagcacagtgtatccaagatgatcggatcgcctccggggtatgttggacatgaggatggcggacagctcagcgaaaaagtacgcagaaatccatattctgtcattttgtttgatgagattgagaaagcacatccggatgtgtttaatattttacttcaggtactggatgacggacatattacggattcgcagggaagaaaagtagatttccgcaatacggttatcattatgacgtccaatgcaggtgccaaggcaatcattgaaccgaagaagcttggatttacccagcaggaagaccagaaggcggattacaagcgtatgaaagcaaatgtgatggacgaagtaaagcagttattccgcccagagttcctgaaccgtattgatgagatcatcgtattccatccgctgaatgaggacaatatgaagaagatcgtagggctgatgtgtaaagaagttgtgcagagagcaaaagagcagcttgaaattatactggttgtgcgtgattctgtgaagaagcatatcgttgagaccggaagtgacaagaagtatggtgcaagaccgctgagaagggcagtacagagccagttggaagacaaacttgcggaagcacttttgaatggtgagatcaaacgtggagaccatgtggaagccggtatttctaaaaaggaaataaaatttacagtcagagagataaacagctagcaaaagaagaagttttattatataataagaaaaacggttcggatgtggaaaattcacagtccacaagtcgaaagagaaagaccattaggaggatttgaacaatgacagtagtcaaagagcttatcagaagtgaattagacggaacactcagtttcggtgattacactctggatacaaagacaaaaaaggatggatttgaatttcagggagatatatataaagtaaagacatttaaagagattacaaagcttgaaaagaatggaatgttcgtatatgaatctgttccgggaactgcagtagagcattttgaagtatcagaagatgtgatctcattcaaggtatcagggacaggagatgcacagatcacactggaacttgaaccggatacagactatatcgtatatatgaatgatatgaatgttggtgatatgaagacaaacttaagcgcaaagcttagtgtaagtgcggaacttggaaaagaaagcgttgagatcaaggttgtaagaaagtaggacaatgattacagcaagagttgtttgaagtacataggtatttaagaaaagtaaaagagtctgcttcggcaggctctttctttaccgaaagtatataaactgggaacaggcaagagaagcagttggtaattttttaagatagataaggagatggaatatggcgaaggcaaaaaagtcggtttttttctgccagaattgtgggcatgaagaatcaaaatggctggggcagtgtccaatgtgcaaggaatggaactctttcgtggaagagtgtgtgacaacatcgaatacggcagcagttaaagcggcaaaagagattcgtattgtaccattgtcagaagtaaagacagagaatgaagagcgggtgacaaccgagattaaagaactggatcgtgtactgggaggcggaatcgtaccgggttccctgattctggtaggcggtgatccgggaatcggtaagtcaacgctgctcctgcaggtgtgtcagaaactggcaaaaaaagaacgaaaggttttgtacatatcaggggaagaatcgcttcgccagattaaattgcgtgcacagaggatgggagaatttaatgatcatctgcttttgctttgtgagactaatctggaactgatccgcaatgtgattgaaaaggaaaaaccagataccgtgatcattgattcgattcagacaatgtacagtgaagaagtcggttccgcaccgggaagtgtgtcgcaggtcagagaggcaacaaatacgctgatgcagcttgcaaaagggcttgggatttcgatttttattgtcggacatgttacaaaagaaggaactgtcgccggtccaagagtattggaacatatggtagatacggttctgtattttgaaggagacaggcatgcatcttaccggattcttcgaggagtgaaaaatcgttttggttcgacgaatgagattggtgtatttgaaatgcgaagagatggtcttcgggaggtggaaaatccgtcagaatttatgctgaatgggcgcccggaaaatgcatctggatctgttgtggcatgttctatggaaggaacacgtccgatcttgctggaaatccaggcgctggtatgcgaaagcaattttggaatgccaagaagaacagcagcaggaacagattacaacagggtgaaccttctgatggcggttttggaaaaaaggattggatatcatcttggaaattatgatgcctatgtgaatattgccggaggtatcaagatcaatgaacccgcgatagaccttggaatcgtgatggcgattgtatcaagctataagaacagaccatttgatgaacggacgattgtgtttggagaagttggattaagtggagaagtccgtgcggtaaatatgccggaacagcgggtggcagaggcgaagaagcttggatttgagacgtgtattgtgccggaagtatctctggatagcgtgaagagtattggtgggatcaaaatcattggagtgaaaagcattaacgaggcaatcggactgattgagtaggagaacatgtaaagaggaaacaggatagatgtgataatttctgttccctcttttacatagcaatgatgttggagtcaaaaggtattttgacccctttgataccagattgctaagtgctttgcactctcgcaatcctcaaaaacattcgtaatccgctcatttttctttgaaaaatggctacttactcatgtttttggcgggtcaagaggtcaaaaatcctcttgcaagcaagcttgcatcggctttctgaccttttgaccctggtatcatagcaattacgaaattataaaagttaaaggtctttaaagatttcgattctggcgagtaaggaaatagcttacttaaacggaagactgaactgaaacacaaaaatgtcagaatattctgaattgtacaaaatacaaaaacaacattgacaattccggaaagccgtggtaagataacattcgttcgctggccgagacagagactaaggagtggcatgcagaggcggagcggatgaaaaataaaaagttttgcataaaaattcgagcatgagtatgggaatattcagacgaaaactttgaaaaaagtaaattgcaaaaagaaatcaaaaagctgttgacaagccttgatgaatatgctattctaaataagctgtcgcgtgaggaactgcttcacaacagcaaaaaagaaataaaaaagttgttgacaaacatgaaatgctttgatataatataaaagctgtcgcatgaaacggcaacaacaaaaagaacattgataactgaacaatagacaacaaaccctgaaaattcttacaagagatttttcaagaacggacatcgaaagatgtcgaaccagaacagtaaacaggaacagaattgccaagcgattctgacccggatacaaacatttttaacgagagtttgatcctggctcaggatgaacgctggcggcgtgcttaacacatgcaagtcgaacgaagcacttatctttgattcttcggatgaagagatttgtgactgagtggcggacgggtgagtaacgcgtgggtaacctgcctcgtacagggggataacagttagaaatgactgctaataccgcataagaccacagagccgcatggctcagtgggaaaaactccggtggtatgagatggacccgcgtctgattaggtagttggtggggtaacggcctaccaagccaacgatcagtagccgacctgagagggtgaccggccacattgggactgagacacggcccaaactcctacgggaggcagcagtggggaatattgcacaatggggggaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggctgtgtaagtctgaagtgaaagcccggggctcaaccccgggactgctttggaaactatgcagctagagtgtcggagaggtaagtggaattcccagtgtagcggtgaaatgcgtagatattgggaggaacaccagtggcgaaggcggcttactggacgatgactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgaccggcatgtaatgatgccttttcttcggaacaccggtgacaggtggtgcatggttgtcgtcagctcgtgtcgtgagatgttgggttaagtcccgcaacgagcgcaacccttatcttcagtagccagcattttggatgggcactctggagagactgccagggataacctggaggaaggtggggatgacgtcaaatcatcatgccccttatgagcagggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctcctttctaaggaagaagaagtaaggaaagttcgttgtctattgttgagttatcaaaactcagatatttctggtggcgatgcggtcaggggacacacccgttcccatcccgaacacgatggttaagacctgatcggccgatggtactgcactggagacggtgtgggagagcaggtggccgccagattataaaaagtttaatatgaaaaaagaaatgaattgatctttaccagtgatcagagattaaaaaggattttggtttctgatgactgataaacatcagtcagacatgtacattgaaaactgcatacaaaaataaatcaattctcaaatagagaaagacatccgaggtgatcatcaccgcaaggtaatgattaacttacatcttcgagaaaacgaagtaaaaaaacgacctgaaataccaacgcatgcaacgctatgcatgtgtaaccggatcccattcccgtgggagaagggagttggttatgctagaaagagcgcagggtggatgccttggcactaagagccgatgaaagacgtgataagctgcgaaaagcttcggggaggagcaaatatccgatgatccggagatatctgaatggggaaacccggctggacagactccagtcatccatacgccaatccataacgtatggaagggaacccggtgaactgaaacatctaagtagccggaggaagagaaaacaacaagtgattctgtgagtagcggcgagcgaaaacggaagagcccaaaccggaatgcgtgcattccggggttcggaccgcgtaattgatctgacaagtttagcagaatggttttgggaaagccagccagagagggtgaaagccccgtaagcgaaagacgagtcagcaaggcgggatccagagtaccacgagacacgagaaaccttgtgggaatgagcggggaccaccccgtaaggctaaatactccttagtgaccgatagcgcatagtactgtgaaggaaaggtgaaaaggaccccgggaggggagtgaaagagaacctgaaaccctgtgtttacaagctgtggaacatctatatatgatgaaccgcgtactttttgtagaacggtccggcgagttacgccatctggcgaggttaagttcttaaggaatggagccgaagtgaaaacaagtcttaacagggcgttaagtcagatggagtagacccgaaaccgggtgatctatccatgtccaggatgaagttgccgtaaaaggcaatggaggtccgaacccacatccgttgaaaagggtggggatgaggtgtggataggggagaaattccaatcgaacccggagatagctggttctcctcgaaatagctttagggctagcctcatgagagtcttttggaggtagagcactgaattcccgcgggggcgtcaaagcttaccaaaggatatcaaactccgaatgccagtaagatgattcatgggagtcagactgcacgagataagttgggcagtcaaaagggaaagagcccagacctgcggctaaggtcccaaaatgtgtgttaagtggaaaaggatgtgggatttcaaagacaaccaggatgttggcttagaagcagccatacattaaaagagtgcgtaatagctcactggtcgagaggtcctgcgccgaaaatgtccggggctgaaacacactaccgaagctcaggaattaacgtagttaattggtagaggagcattcttaaagggaagaagcagtaccggaaggagctgtggacttttaagaagagagaatgccggaatgagtagcgagaggaaggtgagaatccttccggccgaatacccaaggtttccagagtaaagctgatctgctctgggtaagtcggggcctaaggtgaggtcgaaagacgtagccgatggacaacaggttgaaattcctgtactgcagtataacagaactgtggggacgcagagggagagcactagcgggaatggaatcccgcggcaagcgaggtaggagtcgcgctggcaaatccgcgtgacaatccgaagacgtgatgcataccgaactgaagtagggaaatgtgtgagccagctgccaagaaaagccgctattgtttgtactgtacccgtaccgtaaaccgacacaggtaggtgaggagagaatcctaaggccgacgggagaagcattgttaaggaactcggcaaaatgactccgtaacttcgggagaaggagtgccagtgagagctggccgcagagaattggcccaagcaactgtttagcaaaaacacaggtctatgcaaaaccgtaaggtgaagtatatgggctgacgcctgcccggtgctggaaggttaaggggagaggttagcgcaagcgaagctttgaacttaagccccagtaaacggcggccgtaactataacggtcctaaggtagcgaaattccttgtcgggtaagttccgacccgcacgaaaggcgtaatgatttgggcactgtctcaacaatgcacccggtgaaattgaaataccagtgaagatgctggttacctgcgccaggacggaaagaccccatggagctttactccagcttgatactgggattcgatattgtatgtacaggataggtgggaggcgaagaagcattgacgccagttgatgcggagccgctgttgggataccacccttgcagtattggatttctaaccagcagccgtgacccggctgggggacaatgtcaggtggggagtttgactggggcggtcgcctccgaaagggtatcggaggcgctcaaaggttccctcagaatggttggaaaccattcgaagagtgcaaaggcagaagggagcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgaagtaggtcccaagggttgggctgttcgcccattaaagcggtacgcgagctgggttcagaacgtcgtgagacagttcggtccctatccggcgtgggcgtaggatatttgagaggagctggccttagtacgagaggaccgggctggactgaccgctggtgtatctgttgttccgccaggagcatggcagagtagccaagtcaggaagggataaacgctgaaggcatctaagcgtgaagcccccctcaagatgagatatcccaacgtaagttgtaagaccccttgaagacgacaaggtagatagggcagaggtggaagtgcagtaatgcatggagctgactgttactaatcggtcgagggcataaccaagaaggtaggacagggtaagaaagaatggatggagtaaagatttaaatttgtatgtggttttgaaggtacatgtaaaaagtaagggagctgtagaccgtaagggtttgcagtttttttattacatatattacataggaaattatttacctttaaggaaaaatgtggtaatatgctgaaagaatgagagtaatttaagaggcatgagcaaatgggttttttaaatcagctattaaagtacaaaaatatatgtattcaatgtcataacagtccagatgcagatgcactggctgcggcatatggggtgtatacatatttaaaactacaggatatcaatgtgtcaattatttacagtggagattatgaaatccaaaaaaaagatcttttgtacatgattgatatctgtgagattccggtagaatacgtaaaagagttacccaagacagatcttctactactggttgatgggcaatatggaagaggaaatgtatatcgttttgaagcggataatatagcaatgatcgatcatcatatgccttccatgaaaaaaacagaaaatgcttttattgactattcttatcaaagctgttctacaattgtctgggaacttttgaaagaagaaggatatgatgtaaaggcgaatgaaaagttaagtattgcatttttatatggattgtatacagatacttcttcctatgtagatttgtacaagaagcatgacattgcgatgcgcgatgagttaagcaaagattatccggaactggaacggttaaaaaaatcatccatgagtctggaggacctcatgattgcaggagaagctttgtaccatgcatattttgataaagagaagcaatatcttttgatcagtgcaatgcattgtgagcaatcagtgcttggaatcattggtgatatggcaataaaggttgatgttgccaaagttagcattgcatatacggatattgacagtggatatcaggtttcaataagaagtgcggatcgggagtatcttgcaaatgaagtggcagaaaagctctgcgatggaatcggaagcggtggtggccatatagataaagccggcggtgtgatttcaagagattgtatctgcgaaagttatgcaggatgggaaattgcagacattatcaaagagagaatggaaaaaatcatgaaataaaaaaaagaaacagtggtttacaaaaaaggaagtaaaccgctgtttctttctataatgatgttagaattccctgttttgatagaattttatggatagaatccaggaaatcatatacagtaataaacctatgaaaaaaagaatcaaaatatagtaacttcggaaaggaaaatgtgcaagtccgagaggcaaattttttatgacagattgcaaccaaccaagcaatgcgaaaaataaaataaatccaatataataagcaaaccgacctttctcagcacctagtttgaaggtaaacggaaacataaaggcaggtggcagtaatccggctataaagataattgtaaaaatagtaagaagaccggaaatatgaaagttgtgtcttataatcatgttgattgtttgcactacttcaacaatgatggcagaaagtgtaagggtacatactgttaaaatatatttggaggatacaatttcttttcggctacagggaaaggtacaggcatagagactccaatttgatttttcatcgtaagaaagcaggtttaccgggataatgctggaaattgtaataggatataatgcaaaaaacagattgttattccatgctccggcaaaggaaaatacaataatcagaataaaaaataaacgacaatattttatcatcagataaagatctttacgaagtaatcctttcatattcagtgaaccccctttatcataaaaataaacaaatcttctatactgatcggatgtaccttaaatccttccggaatctgatctcgaagaactactgcttctacattgtaagaagagtatttgactccgatgaccgcagattgattgagttcctgaagctgttcctctgtacattgaatgataccgtatttttccagaagccggtctttttcttcgaaaagaacaaggttacctttatgaagaaaggcaacataatcacaaattttctccagatcacttacaatatgggaagaaattaaaattgcatgagattcatctctggtaaaatcattgaaaatatcaaggatttcatcgcgcattacaggatcaagaccacttgttgcttcatcaaggatcagaagtttaggatgatgagagagagcaactgcaattcccagtttcatcttcattccttttgaaaacttaccaaattcttttttatttggaaggttaaatttttggagatattggtcgtatagagaaggatcccagttgtggaaaatatccttcataatgcgtccaatctgtaaaggagtcaggcattcctgaaaaccaacttcatccaatacaacgccaatttcttctttcaagatagtagtagcagaagtgcagtctcttcccaaaattcgaatcgaaccgctgtctttttttatgatatccagaattagtttaatggtggtagtttttccggcaccattttcaccgatgagtcctaagatacatccactgggaagagtgagatttagatgattcagggaaaatccaggatagatcttattcaaatcgtttatttctaaagcatttgtttcaaatgtggtcataagctattcctccatcatgaaatgaagcatctcagtaagttcctgttcgcttagattacaggaagctgcaagatgtactattttttccatgtagtcttcaatttttttcagatttgtttcacgcaaaagatccgtattaagtggagcaacgaaacagccctttgctgcaatcgtgtaaatgaaaccttctttttccagttcatcgtaagcccgcttggttgttacgacactgattcgtagatctttggcaaggcttcgaatggaaggaagagcttcgtcagatggtaatgttccacttataatttgcgatttgagttgtgtaaaaatctgttcatagatgggtgcaccacttttgttatctatgaatatattcacgttttcacctcgcttaaaatgttataactgtatatatacagtatatacagttggcaaaggtgtgtcaagagaaacaatcctgcttgtatagaaatttgattcatggtatgataactttcatagattaaacggaattaccagtcgaataatatctggagaaatcaatgtatgaagagtaggagaataaatataatgatttctctgattaaagttaaggtagtgggaggaaggaaaaatgcagacttttgcgaatacaggaataaaaacggaagttatagacgaaattatttcatttgcaaaaaaacatgatatacattgtgtgattctttttggatccagagcgaggggagacttcaagaggacgagcgatattgatattgcggcaagtggtggtgattttgatcgttttgcattagatgttgatgaagagacatccacgttgctggaatttgacattgtggacctggatagagatatgcaagacgccttacgagaatcgatacggagagaggggaaaattctttttgaaaaagtatgaaaatttttgtgtgtcattggaaaatatgaaggatatttataattacgaagaaccgtatgataatgtcgttctaactggtttggttggattatatgaaattacatttgagcagtcatggaagatgatgaaagaaatattggagatacatggatttgcagaaggagcaacaagttctccgaaaatgattctcagaacagcatataaagcaggtatgataaaggatgaagaactatggttatctgcattacaagaaagaaataatgtaacacattcttataaccgaaagattgcaatggggattattacgcaggcaaaacagaagttttataaaatgttctgtgaattaaaagaagaaattgacaggaattggatatagtagtcaggagcataaaatggatacaaatgaaatcaagatccgcccggcaaccgaagcggacgcagcagaaattttaaatatctatgcaccctatataacggacacagcaattacatttgaatatgatgttccgacactggaagagtttacgggacggattcgtcacacactggagaaatatccgtatctggtggcagtaagagacagcgagattatcggttatgcatatgcaggagctttttatgggcgggctgcatatgactggtcggcagaaactacgatttatgtaaagaagggttgcagtcacagtggtgttggaaaactgctttatcaggcacttgaaactgcactgaaagcacagaatatcatcaatctatatgcatgcattggatatccggaagaagacgatgaatatctgacaaagaacagcaagcagttccatgaacatctgggataccgtttgatcggagaattccggaagtgtggttataaatttgggcgttggtaccatatggtctggatggagaagatgataggagaacatccggagaaaccggagcaggtaaagagattttcagaaatatagtgatggaaattaaaaaacgggagaatgctgtttgaaaatgcattctcccgtttctcaatattgttatgagagcatctcttcgatcttcgcctgcatttcagcgacggtatgctttcgtgaccgggcacattcctgtgcctgacagccgcagatcaaacatttgcggtagacgccgcgggagagtttttctccgtctgttccaatcacatccatatcaaaaagacgtccgaagggatggttttcttcgagttctgttgttagttctttaattttatctgccggatagtcgactgtaagaataatttcatttccagtcttctcatcaaactcagtttgggtaagaatcggaatgttctctttttgtaatacagcaaaaagtgcttcctttccggaaaggaatgcttttttgatctgttcattcgtctttataggtcccggaatattcatgcagaatgaaatcactgggcaatgatatctttgaatatattcattttgtatattaacgcggcgctcgcggcaggcgagcatgtcggttaatactacttcctgtcctttcatagcagatcctcctaataatgaataacattttcttgttgtctgatccgttcgattacaggaattgcttccggacttttgaaataatccagtgtggtttgcggtaccagcttcgaaagggcatcatagtcaccattttgcagggcaagacgtacattggaagcgctgatcggtgtatcctcacaggtctttcttgggacaacgatacattcgatgccctgttccggtaatttttcagacatgatccggttatagattccggtaaccaggctagtaggctcttcccctacgtaacggcgagtgataccgagcacctttgcaatctgcgtaaataccgtcaggtccagcatggcgtggctttcaatcactgcattctcatctttctggaaatagcttggaaaagtagtattgctgataatatatggaccactgtcgtgataacagatgtttttcaagtgtgctgttcctttcatgacgagttgttttctgatcttgaatggaaccaggctggcatcttcactgacaatgaagagatgaagcagatcattttcagcagccgctttttctataagatactggtgtccgagggtaaacgggttggcgttcatgacgagagcagcaatctttctggtgggagtctcagcagtcaatccttctggaagtgcatcttttgcaaaagtacgcagataattctgaaatccggtttttcggttttccatgaagacaatctgtccatcgatccgggcaatttcatagaatccaagatcaccgaagaacttggcagaattacatttggtgtaaagaaaaaggtgtgtattccctcttgaaaactgaaattcaatcagatgagagacgatggaattcatcagtccttctccctgatgttcatggcttacggcaaaacatcgtaaggtgttgccaaaacagcttcctgttgcgataatgtgcatctcatcgtcatacatgccgcaggtgtaatccaggttagcatctctgcggatcccttctgagataaggagcgcgtccacttcatcgttggctcgcttgtcagaaggatagatttgagaaatataataatctgacatagataaattcctttctgcacagtagctcaaaatatttgatgaaattattttaacatgtgtatagaaaatgtaaagaggagcaaggattcaagaaagaaatcaggcattattcttaaaaaaatacaaattggatttatgtcatattgatatgatcacaatatgaattatgtaatttactaataaccaggataaccctataatatagtcggataaaaaataatcgtatgatttatagtaaaggaaggatagatatggcaaccattttcccaagagaagaaaaagccgagatgttatttgacaagattcttgcaaacccggaggcatgcaggcgactgaaaagaactttttatgatgccattgattccggagatgagtttgtgacagagaatcttcccgcaaagcagttcaccgctgcattattcgatgcatatgaaaataaagatctgactgcatttctcatggctgtgtgccaaaacagtatgttcgatcttttaagaaatgcttttctgataccgtttaaatttaatgcggatggacacacaaatcctatttttttgacagatgaagagggaaagcttctggaaaatcttccgattcatgtaaaggaaaaagaatatgaaaaatttcgaaaagtttatcagaagcgtgataaagtaaaaatgtatctggcacatggatataagaaaaggcattgttatgattcagaaacaatggaaacacaggaatataagatgggagagcatgacggagtacttctgatctatgaacttccggataccgtaaaagaaaaaaagacggaggctgaagcttatgcagctgtgtgggatattatgatggaacttcaaaaggaactgccaaattctgtggtatattacggacaggatttcttgcaggaagaaggaaaaagatttgatgaaatgggggttttccttccgctggaacacttttctgacagactggaaaggcatatagaaaaagcggatcaaattgtatatggtaaataaaaagatgcatctggttgaaaaaagatcagatgcatctttttatttaaaattcttttttacgtgcaataacggaatgtcttgtccgtcagaattcttgcaaagataagtccaagaggcaaggcaagaatgataagtattgcagctgcaaaccaggatgcagaggtttgcagagacatcactccaagattatagattgcccggtaaagataaagtcccggtaccatgatgacaatagaaggtacagtcagagaaattctcgggtaaccgattttgctttttaatacagaagccagaattccggcagtcagggcaccgataaaagctgcggctgcaggaggcagggaggccaagtctaccagttcaagacggagtgtattggcaattgctccaatgataccggctgtggcagagagttctttaggactgttgaacataacagaaaagccgaacaccccgcagaagctggcgagaagccggaatagtatatgttgccagagtgtgagagaaagaggtgggaaatcacttggctttaaatgaaggataagtgccatgatccaggcggtcaaggttgcgacaagaatgatgatcattgcgtaagcaagtcgttccaggccggatcgcatatccagttttgcaaggtcgattccgctggtgataaatggaaaaccgggaatgatgaaaagcatagagcatatatatccggcttcatgagcaagagaaatgccgaacaacagttcagttgtttttaaaagtgcagcatagataaggcaggcagcagcaacagaggcagtaatgcctaagaataatgtgaaatgatgcttagtcagtttacatcttacaaagttgccgataccggcaccgaaaaaagcaagaagcatttctaccggtccgccaccaaggagaaaggtaaatgccccacaggcaaatgctgcggcaaatccgagtgcaactggagagtaaaggccatggatccgttcaatctcatccagataagaatgaatctgttcaccggaaagatatttttcctttgttgggaaatcgttgatgaagttttccagtcggttcaatttcgaagtattaacaccggtattggtcagacacagcgactgtgaaaaacagttttcaccgtcaaaacaggtgtattcaatggacatcaggccaatgtcggcggtacagctgattcccagttctctggaaagggtattcatagagcttcgaacacgccatgctccggttccacaggaaagaagcatcatgccacatctaccgaccacggaggctttttcaattagcccggcctttgtgataggaatggtatcttctttattcagtgcataatcatgccatagaatgtccatatgatttttttctattatgccttgctgcataaatttcacttccttttgctataccaataatatatgaacaatatattaaatatgtattattggtattgatttatcataataaagtataatcatcgaaatgcaaaagtcaatagaagagttgagaaatcctgaaaaaggatacggatatgccaatgtggatttaaaaacatgaccgaggcaatgtgcataaaatgaaaaaccattttttgtctaatgtgtataagaaaaagtaggcaaaagaaaagagtgtgaaatatgttaagttttggttgcgattttctatctgatcatcggagtaattgtgatgcttttatatgttcgctttgaaagacaggaagaaaccgttttgaaagaactggaaaacagaagaaaaagtatgtagaaaacaccggcagtttttaaagtaataaatgctaataaaaaatgctaataagcaagaaagcctgtttttcttgacactcattatgttcggtgttacggttatctaggatgcaagatatggtgcagatgcggagaatacggtatccaaagtgcaccgcttttgagagttttataaaactcagtttacaagaaaataaaacaatgaggtgtaagaacatgcaggaattaaaaccgatcaaagaaggtaaagtacgtgagatttatgacaatggcgacagcctgatcatggttgcaacagaccgtatcagctgctttgacgtgattctgaataatgaagtaactaagaaaggtactgttctgacacagatgtcaaaattctggttcgatatgacagaagatattcttccgaaccatatgatttctgtagatacaaaggatatgccggaattcttccagcaggagaaatacgaaggcaaatccatgatgtgcaagaagctgaacatgcttccgatcgaatgtatcgttcgtggctatatcacaggaagtggctggaagagctacaaagagaatggaactgtatgcggaatcaaacttccggaaggattacaggaatcagacaaacttcctgaaccgatttacacaccatctacaaaagcagagatcggtgatcatgatgagaatatttcttttgaacagagtatcgatcatctggaaaaatatttcccgggaagaggaaaagaattagcagaaaagcttcgtgacaacacgatcgctctctataaaaaatgcgcagaatatgcactcagtaaaggaatcatcattgcagataccaagtttgaatttggtcttgatgaagaaggcaacatggtgatcggtgatgagatgctgacaccggacagctcaagattctggccggcagatggttatgaaccgggacacggacaaccgtcatttgacaagcagttcgcacgtgactggcttacagccaatccggataataactggacacttccacaggagatcgtggataagacaatcgaaaaatacctgcaggcatatgagatgctcacaggcgaaaaacttgcataattacatcacatgccatgagaataaaatatgacgaaaggaccggcggtttgagactgccggtctttttgcactggtaaaactgtccagttttggtataatcaagacagaatatcagttgcagaaaagaaaaagaagaaaaaggagatattatgaaacgaccatttaagagaattttatacggtggagattataacccgaatcagtggggaaaagagatctggaaagaagatatgcgcattttcaaggatgcccggatcaacagtgctacgatcaatgtattttcgtgggcgaagatccagccttcagaagaaatctataattttacagaactggatgagatcattgatatgctgagccgggagaactatgatatcgtgcttgcaacttcaacaggcgcgcttccggcatggatggtaaaaagatatccggaagtagcgagaacggattacgagggacgacatcacaaattcggtcagcgccacaatgcatgcccgaattctccggtgtttcagaagtttgcatcccgtcttgcaggcaaacttgctgagcgttacggggacaatccgcatgtgacctgctggcatatcagcaatgaatacggtggagaatgttattgtgaaaactgtgaaaaagcgttccgcgtatggctgcgcgggaagtatcagactctggatgaactgaacaaagcatggaataccgaattctggggacataccatttatgactgggacgaagtggtactaccagatgcacttggcgatgggatcgaagatgctgcagaaccgcatatgacggcttttgcaggtctttccattgattactgccggtttaattcagatggaatgctgaataacttcaagatggaaaaagaagcgatccgtaagtttgataaagagacaccgatcactaccaatatgatgggaacctttaaaggactggattatttcaaatgggcgaaagaaatagatgttatttcgtgggataattatccatcttataacacgccgtggagtatggtggccatgaagcatgatctgatgcgtggacttaaggataaaccatttatgctgatggagcagactccaagccagcagaactggcagccgtataactccctcaagcgtccgggacagatgcgtgcacagagctatcagaccatggcacacggagcagatacgatccagtttttccagctccgtcgcagtgtgggaggatgtgagaagttccacggtgctgtcattgcacatgcaggaacggaaaatacaagagtcttccgcgaggtgaagcagcttggtgaagaactggaaagattaagtgacctgatcccgggatctgtaaatgaagcagaagttggagtgatctttgactgggataattactgggctttggaatacacaagcggcccgtcgatcagtctcaaatatgtggaccagatccaccgctattaccgttatttctatgaaaaaaatattggcaccagtatgattccggtggatgcggatttctcaaaatataagatggtggttgcaccggttctttatatggtaaaaccgggaatgaaagaagcactggaagagtatgtgaaaaatggcggtattcttgtgacaacctatatgagtggtattgttggagagtcagataatgtataccttggcggatatccgggaccgttaaaagagatggctggtgtctgggtggaagaaatcgatgcccttgcaccggaacagcataacatcgtgacgttcaaagacggaagccggagcaaatgtaagatcgtatgtgatctgatgcatctggagggagcggagtctcttggcgaatatacggaagatttctacgcaggcatgccggcagtgaccagacatagttatggaaaaggaaaactgtattacatcggaacctgtatggaagaagatggaattgcgaagattctttccatggcagtagaggatgcaggagcagaaccggttgcaggagctggaaacggtctggagatcgtgaaacgtaacagagaaggaaagagcttctattttgtgatgaacttcagggatgaagagctggaaattccggaagaatttgcaggcaaaacagatctgctgagtgggaatgcagtaggaaaaggagaaaaacttccgaagtttggtgtgaagattgtagtggaataaaaatttaagattgaaagtaaaaggaagcaggaatttcagacaggtgtaaggctgtcagggattcctgcttctttgggttaggcgggaattatttaatgaaattattactgtgacggatgaggatgcctatgagacggaaagactttctgcaaagacaggaggaatttcggttggaatttcatcaggagcagcgctctgggcagcgatcaaggtggcaaagagagctgaaaatgcagggaagaatcttcttctattcttcaatcacctggatttccagaaaatcaaaatcaattgaatccacgaaactgtcctgatagaatctcgctttggaatgccgcttgaattcgttgatattcacatccagccagatcggtttgctgagatcaaattcatagcagatctcatccagagcattgaaaatcttgtgggttcttgtatcgtcactgtcatcacagatggtggtatctttgatcatatgattgtctttaaattcttttccccataagcggaacatggtaaaatcctccttataataaatatgaaaaatgccggtcaggcaaagaatgtttttgtatcaagtgattttcagtatagcggatttaggggagaaagtaaaggagacagattttattctatgatatgatgtgctatattgatactaaagtttatgaaagaaagagaatcattctcaataacatggaatagaatagagaaaaaagacagggaattagaaaaatgtctggaataaaacgagaaactataatccgggttatattgggaatctgtatgatagttgtatcgattggtatgatatatggtaagtcaaaagctgggaatgcaaatggaaacgacagaacttatatagaagaatcagaaaaaaatgcaaaacagaagaaggcagagaaaagcgaaaacgacagcacgggatcagcaaaacaggacagcacagtaaaaactaagatgacagaacaaaggcaggtatcgggcaccgaggcagaagctatcgaggcatccatccagccgggacagtatccggtgatggggatcagcagtatccgcgcctggcaattggtaaattattttaaagcgtatggaagcacttatccggcagaagttttgacgcagggaggtgcaccggatattgagacatttgcacagatgtattatgaagaagccacggcagaaggcgtccgtccggaggttgcatttgcacaggcgatgaaggagacaggctggctgcagtatggtggggatatgcagatcacccagtataattttgccgggatcgggacgacgggaggaggcgtaccggggaattcctacccggatgtcagaaccgggatccgggcacagatccagcatctgaaagcttatgcgacagacgaagcacttgccggggaatgtgtagatgaccgttactcttacgtgacaaaggggagcgcaccgtatgtagagtggctggggcagaaagaaaatccggaagggtatggctgggcaacgggtgaacgttatggatacgacattgtagaaatgattcatgcaatgcgaaaataaaagaaatgtgtcagattgagattatctaatttattaaaatactatgaagcttgcccgggctgtatagatttcaaagagaaaaaatggtatactgattttactttcgggacgaaaaagggagatagattccggagggaagtatacataaaaaggggagattacatgcagtcagcaatgaagtattacgatgacgtagacagctggaagaccgtcatgtttctttacaattccgcattgaaagaagtagggacgaagctggagatactgaacgatgaatttcaacatgtacacagatataatccgatcgagcatatcaagaccaggatcaaatccgcagaaagtattgtgaaaaagctgaagcggtacggatatgagacaagtattgagaacatggtacgctatgtcaatgatatcgcaggagtccgtctgatctgttcgtttacatccgatatttaccggcttgcggagatgatagggaatcagagcgacttaaaggttctgtcaatcaaagactatatcaagaatccgaaggaaagtggatacaagagctaccacatgctggtgtccgttccgatctttctgtcggacagtgtggtggatacgaaggtcgagatccagatcaggacaattgcgatggatttctgggcgagtctggagcataagatttattacaagtttgaaggacaggcaccggagtatatcagccgggaactaaaggaatgtgcggatatggtatcggcactggatgacaagatgctgtcactgaatgaagcaattctggaatgtctgaaagaaggcggtgagaagccggttccggagaaaacagaagaagtggatgcggagatcattgagaatcctatgatccgataaagaaacacaagaaagtaattataagaaagcaggagcagtcaattgattgttgaggagtatactcaacgttaactgactgttcctgcttttttgacaccgaacagaaaaaaatcatatttaacaaaaactttacacagccaggatttcagattttacaaccattttatatgatagagaccgtgaagaaaagaaaaaataaaaacacataaaacggaggattttagtattatgaaattcagaaaattaatggcagtagcacttgtagcagcaatggcagcaacaatggcagttggatgcggaggatcatcatctgacaagagcgcagagggcagtacggataacagcagcgcagatagcggaagtgattttgatacatcaaatgatatcacaatcgtatcccgtgaagatggatccggtacaagaggagctttcattgagctgttcggaatagaagaaaaacagtcagacggaacgaaagtagatatgacaacaacagatgcgcagattacaaataatacatcggtaatgcttacaactgtagcaggtgacgaatatgcaatcggttatgtatcactcggatctttaaatgacagcgtaaaggctctgaagattgacggagcagaagccacagcagacaatatcgaaaatggttcttacaaagtgtcaagaccttttaatattgcagtgaagaaagatcttgataatgaagttgcaaaagattttatggcatatattatgagtacagaaggacaggaaatcgtatcaaatgaaaaatacattccggtatcggatgtagaagcttatgcaggatcaaaaccatctggaaaatgtgtagtaggtggatcttcttctgtatcaccgctgatggaaaaactgattgaagcatataagaaagtaaacccaaatgcagacattgagcttcagacttcagattctacaacaggtatgacatctacgatcgaaggaagctatgacatcggtatggcatccagagaactgaaagatgacgaagcttcagaacttgaagcaacagtaatcgcaacagatggtattgcagtgatcgtaaataaagctaacacggcagatgagctttcagcagatcaggtaaaatcaatctatgttggggatgttacaacatgggatgaagtttccaaataaataaaagaggaaattaaagaatgaaatcaaaagcatggactgaaaaagtcatgcagggagtgttcttcattgccgcctgcacttcggtgctggcggtagctctcatttgcatcttcttgtttgcaaatggaatccctgcaatcagacagataggatttgtaaaatttataaccggtgatatctggcgtccgggaaatgaactttttggtatttttccgatgatcatcggaagtatctatgtgacggcaggagcaattatatttggtgtgccgatcggaattctgacttcggtatttatggctatgtattgcccgaagaaaatttacagaccgttaaaagcagcaactgaactgctggcaggtattccttcggttgtatatggcttcttcggtatggtgatcgttgttccgatcatcagggacttcggaagaactttaaaaatgatgggactggttcagaaatccggcgatggaaaaggaatcctgactacatcaattgtacttggtatgatgatccttccaacgatcatcgggacaacagaaagtgcaatgcgtgcagtgccaccacagtactatgaaggctcgctggcacttggagcaacccaggaaagaagtatttttaaagttgtgattccggcggcaaagtccggtgtgatcacaggaatcgtacttggaatcggacgtgcgatcggtgagaccatggcagttattatgatcgcaggaaaccagcctagactggtcaataatattctgctcggtgtccgtactctgactggtaatattgtaattgagatgggatatgcgaccggacttcacagggaagcgctgattgccacaggagttgtactttttgtatttatcctgatcatcaattttagtgttgcgctgcttaagaggaggggtgaacatgagtgatcagacgaaaaaacctgtttatatcaaccgggaaaattttacagataagataaaaagctatctgagacatccgggatccatgattttgatgtttcttgtgatgcttgcgacatttatcacgtttgcattgctcctgttcctgattttttatattttgatcaatggaattccgtacattaaaccgtcattattttcattacattatacatcggacaatgcatctgttataccggcattgatcaatacggttgttatgacactgctttcgcttttgatcgcagtaccatttggcattttttcagcaatctttcttgtggaatacgcaggaaaggggaataaatttatcgaagtgatccgcctgacgacggagactctttcgggcattccgtctatcgtatatggtctgtttggtatgctgttctttgtaaatacgctgaaatggggattttccgttctggcaggtgcatttactttatcgatcatgattcttccgctgatcatgcgccagacagaagaagcacttaaagcagttccggattcttacagagaaggaagctttggacttggagccggaaagctccgtaccgtattccgtatcgtgcttccatcggcagttcctggaatccttgcaggtgtgatccttgccattggacgtatcgtaggagagacggcagcactgatttatacagcaggaacggttgcacaggtgccaaagaatgtacttggttccggtcggacactggcaatccatatgtatatgctgtcaagcgaagggctgtatatgaaccaggcgtatgcgacagctgttattttgcttgtactggttgttgcgatcaacaccctttccggtgtggttgcgaagaaactgacgaaagcatagagaggaaaagaaaatgtcaaagataagtgtaaaaaatcttgatttatattatggcgatttcaaggcgctgaaaaacattaaccttgagatcgagccaaataagatcaccgcgttcatcggaccgagtggttgtggtaaatccacacttctcaagtcgatcaaccgtatgaatgatctggtagaaggatgcaggattgacggcgaagtccttctggacggacagaatatttttaaaggaatggacgtaaatgtcctgagaaaaagagtcggaatggtattccagaaaccaaatccattcccgatgagcatttatgataatattgcttatggaccgagaacgcatggaatccgttcaaaggcaaaactggatgatattgtagaaaaatcactgcgtaatgcagctatctgggacgagtgtaaggaccgtctgaaaaagagtgcacttggcatgtccggtggacagcagcagagactttgcattgcacgtgcacttgcagtagaaccggaagtacttctgatggatgaaccgacttccgcactggatccgatctcaacatccaagatagaagaccttgcgatggaactgaaaaaagattatactatcgttatggtaacacataatatgcagcaggcagtccgagtgtcggacaataccgcatttttccttcttggagaagttgtagaatataatgatactgaaaaattattctcgattccgtccgataagaggacagaagattatattacagggaggtttggttaaatgcggaacagatttgacagacagctggaagaacttaatgagatgcttatccatatgggagaactttgcgagacggcaatcgaggaagcaacaggagctctggaaggacatgatattgccagagcaaaggctgtcattacagcagacagcgagatcgatcagatggaaaaagaaattgaaaatctctgcctgaagcttttgcttcagcaacagccggtagcgcgggatctgcgaaggatctcggcatcacttaagatgatcacggatatggaacgtatcggagatcagactgcggatattgcagatattgtgatcgcaacaaaatcaacagaggaaaagaatctgaaggatattaaccggatggcagaggcgactgtaaagatggtaagagacagtgtatctgcctatgtacagaaagatctggagcttgcaagaaaagtcatggatgcagatgatgaggtagatgatctttttgatctggtaaaaggagatctgataaaatttatttccgatcacaaaggaagtgccggagatgaggcgatcgacctgatcatgatcgcaaaatatctggagaggatcggagatcatgcaacaaatattgcagagtgggttgaattttcaattacaggtattcatgcaggcggaactgcaatctaaaagaaattaaaggagaacgagaatgattttttgtgtggaggatgaagcgaacatccgggaattagtagtatatacacttgagactacgggatttgaggcccgtggatttgaagaaggcacatcattctttgaagctctggcagaggaactgccagagctgattttgcttgatatcatgctccctggagaagatggaatggagatcctgaagaagctgaagacttccgggagaaccaaagatattccggtcatcatggttacggcaaagggtgcagaatatgacaaggtcatgggactggatgcgggagcagatgattatgtgaccaaaccatttggaatgatggaactggtatccagaatccgtgcagtactcagacggacatcgaaaaaagaagaggatgatacctatgtgctgggtgagatccgcatggaccgtaaaaagcatgaagtaacggtagcgggagaaccggtagcattaacattgaaagaatatgagctgttgagaaaacttatggagaatcagaatattgttctgacaagagataaattactggaagaaatctggggatatgattttgacggtgagaccagaacggtagatgtccatgtaagaaccctgcgccagaagctgggacaggcaggagaatatattgagactgtccgtggagttggataccgtataggagagatcgatgcgaaatagaatccagaaaagtatgatttttgtggttacgatgtcactactgatctcgtatattctggttactctggttatttaccggcaggcgctggatatccggcgcagtgaactggttcaggaggcaggatatatccgggcggcaatagaaatatccggagaagaatattttggcaccatggataaggtcagtaagcgcaccagggtaacatggatcgataaagacggaaaagtactttatgataccggaaatgatcaggaaacgctggcaaaccacaaatcaagaaaagaattcaaagaggcattggcaaatggcagtgggcaggatatccgtatgtcagacagcaaaggacaggagatgtactattatgcgttgaagatggatgatagctctgtcctgcgtgtgtcaagaggcatggatacggtctggaatacagcatttatgatcttaccgtatatgattgcgatcggggtcatgatggcatgtgttgcatggtttatgacaaggcatcaggtgaaaaggctgattgcaccgattaacaatctggatctggaagaaccactggaaaatgatgtatatgaagagttgcatcc
